United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 14

SEQ ID NO: 348 - DNA, 141729 bp, Homo sapiens
tgccatgggagaagttaagacaggaataagtagattgtttgtttcttttttcatttttacttttagaaaggctaagatgctcagaattggagctgtcataatccttgttttacaagagtttatcattgacccctgcatatcttttattttccttattaataaggaaatgataataaggaaataattatccttaataataagcccccttgagcccatctcccaatcctggaactaaaccatggcaatagccaccgttcacccatgcacaccaccccttcctgtctccattcacccatgcacactaccccttcctgtctccattcacccatgcacactaccccttcctgtctccattcacccatgcacactacccccttcctgtctgcattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacaccaccccttcctgtctccattcacccatgcacaccaccccttcctgtctccattcacccatgcccaccacccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacacctccccttcctgtctccattcacccatgcacaccaccccttcctgtctccattcacccatgcacactacccccttcctgtctccattcacccatgcacactaccccttcctgtctccattcacccatgcacaccaccccttcctgtctccattcacccatgcacaccacccccttcctgtctccattcacccatgcacaccaccccttcctgtctcctgacctctctgctgccaaagtggatgctgttgaaattatcattcccttgcctgttgaaaaagttttaacaaatgtacatgggtcagtattaattactatttatttttagttggttttgaacttaataaaatttacagcatatccttgtccaaatttgccagtttttcttttatagacagagttttctgtgttttaaaacttttgctctaacccaaagtcagaaatatgttcatctgtattttcctagaagtttataactttaaatctctagagtagagcgagttgatttttgcatggtctaaaataagggaacaatttcccttttctccatatggaatgcatagtcgttttccacctccatgtccctttcctgaagaatgtcttcttttcattttggtttttctttttgagtctcgctctgtcacccaggctgaactgcaatggcacaatcatagtttgctgcagcctcaaactcctgggctcaggtgatcctcctgcctcagcctcccgagtagctgggactccaggcatgcaccaccttgcctggcttctttttttccactgatcttccatttaaacctcactcacacatcacagccccataaatgtgaagggccatttgtcattgatcagttagttgatctatcccagtatcagcatcccattgttttaattactatacttacctacatcctgatgtctggtaggacactttcctttatgattccaaatggattttagaatatatttgtaacattcatgaaaagtttaagattttattaaattgcatagaatcaataggaatatgtagggagagtaaacaatctttacgattttaggttttaccatcctccaaatggcttattatcccatttacttgagttttaaaatgtctttcatcataaagtttcataattttctgtgtactgatattgtacatttttgtttgatttattcctaagtgcttttagagttgccattgtaaatgttttaaggattatattttctaatttttacaagtatatgtaattgagctttttaatattgatcttacatctagctgctttaatacacttttatttctaatgatttgcctgtagtattttgtgttttctatgtaggcagttgtatcctctgcaaacaatgataattctgttttcttctttccaatctttatgctttcactttattaaattttctccatttaagattacatccattataggatttttataaacaccttttaccaggttaacaatttattcatagctttctaagagctttcaaaggcatttctgttgagtttttttagtttttctatatctattgagatgataatatggtttttatcttttattctgttaacatagttcatgttagtttaagattttctcagattcaatcattcttgcattcctgagataaactaacttggttcttttttttaaatataccattggcttttgtttgctaacattttgtttagagtgtttacacttacattcatgatgaaatgggcttataattttttcatttccttactatctttggttttgtatccaggtatacacttctcttaaaatgtcttgaagggtgttgtctttttattttttggaagggtttatataagattggggtgatctgagtatttggtaggattctttttgttaaactctctaggcctgaagtttttcttatggaaaaaaatttaactattactttggtttcatttgtacttatcatttttttaagctttcaattttttattaatcagtgtcattattttacactttttccaggcatttgtctatttttttctgggttttctaatttattaatagagagttgataatacttcatctttataaaatcggctgtatgattatgttctttttaatttaaaagtattattaacatcttctgtttgttgtgatcagcctttccagctgtatttcctttagtctagttcaaagttagttcacatcaacttcgtattgttgttttctgtgtcactggcttctactctttatctcttttcttcagttatcttttcttcctatctaacatcttaagttcattagtgtgtcttttctcgtataaagttataaatttcccttgaagcattgctttccctgcatcctgcaagcttgtcgtgctttcattgtaatccagctctctctctctatagctgatacacgggttctttagaagtgtattttataaaatttctaagttagtgccatttgataatttaacttccacttagtagccagggttaatttaccatgttgttggaaaccagagctcctaacatgaaccccaagtttttaaaaaatagtaaccaagcttagttgtgattttctggtgtattgttcaatctaatcagcactgtgattagtattttagttttgtaacaagtttttttctgttactcagcttcgtactcttagtactgcagatagaataggtattttaatcttttctgatgtcttcatttccaggttttggaatgtaatacatttgaaaatagtgctgtgagacagtggtccactgtcttgtgtttctacctgtctggtgagaagcagtactgactacctttgtccagatgatgtttgtgaggttgtttgtacagcagactgccccagaaggtagagatggtgtctcccttcagagcagagggcaggcatgcttacaggccagcgtcataaaaataatatcttgcttcagggcaaaagtcagacaaggttactgcccattataaaggactccggggtccctcagcccaggtttcccctgctccaattcagccacctgtgtgtgtgtggcatcactggtcccgttcactttgctcctttggaattagagcttgggcaatgggtaccagttatactctttttgcttctgaccacatcttctgtctctgactcaaggatctcatgtcttgtttcctaccccttactctgaagtcatttgtcatagaccttgtttggtttgttccctctctttctgctcctcttcccctccctccctttcaccctttctttttgttgttttctttctctcctctcaaacaggtgagggctgtatgcggcccacccatcactgggctagacggtgggctggcttggcctggtcgttgtctctcacctgctgggcagcttcttctccaggaccggtgcctgcacaacttacctggtccctgtctcactgctttgaagcctcctgccttccccacatagttctctgtgcactggcacatatggaaaatcagagtcccagcaggtgctgtccccggggccctcgccctctttcccctcttctgtcgtgtggatcgcactccagggctgtgtccctagaatggctgtgggcgtctcactgttctctccctgcttcctactaagttcctcaggagttgctgatttggatgagggacaaccagcagcacatgggcctgaggaagaggaagggctgctgagccccggcttctcgccaaggtgaggccgcctgccttctcaccgtctccgcttcggaaacaatgtcttcaggaacaacgcgggtgagacagcgctggaaattctcgctggggccgtgctctctctccttttccctcacagtgtgtggagattacgccccaaatctgacgcaagtccagccatctctacaaggattttattggaaaattagaggcagctgttttggtgactgctcatcaaatgctatcagaaggcagcattgttgtttaaccctttcctcccccgtcccttttcctcctactctatccccagagaagtcttttaagaagggactagaaaaaagctttattattttcaatttgtatggttacttacatgtgtcttcttcttctggtaactaaatggaatagggattgtgaagtgcggaatggtcacgaggctggaggcaaagaccccagcagaatggtagggaggctggaggcagacaccagctgtggtagatgaggccaagccagcagagagggtctgagtgtcagagaaaatggagaagggccagagaggggtgaggatgcagacaggccacctgcgacacccatgggggcatgcgtaaggggtccttgaaccttaacagagatgctgctcctgataagggcctgtgaccacgagagcctttccccctagtcaccgtcctcacatgcgtgcgtcagtgacctggtgaatattcaatgtgatgacccggtcactgtcatcacgtgtgtccatcagttacctggtgaatactgaatgttgtgatgacccagtcaccgtcatcacgtgtgtgcgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaacgttgtgatgacccggtcaccgtcatcatgtgtccgtcagttacctggtgaatattgaatgttgtgatgacccggtcaccgtcatcacatgtgtccgtcagttacctggtgaatattgaatgttgtgaggacccggtcaccgtcatcacgtgtctgtcagttacctggtgaatattgaatgttgtgatgacccggtcaccgtcatcacgtgtccgtcagttacctgttgaatattgaatattgtgatgacccagtcaccatcatcacgtgtgtctgtcagttacctggtgaatattgaatgttgtgaggacccggtcaccgtcatcacgtgtctgtcagttacctggtgaatattgaatgttgtgatgacccggtcaccgtcatcacgtgtctgtcagttacctggtgaatattgaatgttgtgatgacccggtcaccgtcatcacgtgtgtccgtcagttacctggtgaatattgaatgttgtgaggacccagtcaccgtcatcacgtgtgtccgtcagttacctggtgagtattgaatgttgtgatgacccggtcaccgtcatcacgtgtgtccgtcagttacctggtgagtattgaatgttgtgatgacccggtcaccgtcatcacgtgtctgtcagttacctggtgagtattgaatgttgtgatgacccagtcaccgtcatcacgtgtgtgcgtcagttacctggtgagtattgaatgttgtgatgacccggtcaccgtcatcacgtgtgtccgtcagttacctggtgcatattgaatgttgtgatgacccagtcaccgtcatcacgtgtgtccgtcagttacctggtgaatattgaatgttgtgatgacccggtcaccatcatcacgtgtgtccgtcagttacctggtgagtattgaatgttgtgatgacccggtcaccgtcatcatgtgtgtctgtcagttacctggtgagtattgaatgttgtgatgacccggtcaccgtcatcacatgtgtgcgtcagttacctggtgaatattgaatgttgtgatgacccggtcaccatcatcacgtgtgtccgtcagttacctggtgcatattgaatgttgtgatgacccagtcaccgtcatcacgtgggtgcgtcagttacctggtgaatactgaatgttgtgatgacccggtcactgtcatcacgtgtccgtcagttacctggtgaatactgaatgtggtgatgacccagtcaccgtcatcacgtgggtgcatcagttctggtgaatactgaatgttgtgatgacccagtcaccatcctcacgtgtgtgtgtcagttacctggtgaatgttgaatcctgtgatgaatagctatgatttcactagaccggtattggatttttttgtgaatttaccacttttcactattataataatgtgatacatttcttagttcttaaatccttgcctagatatctcttttcagttggattcctagaaatgagattcagttaaaggacataaacacacacgttcaaggctttagaaagtcacttggccaagtgcgtaagacacacgatagagactgcagcccccacggcaggagctcccatcctccccaatatcagcggtttcatgtttggcttttgggtaactttggagcagaaaaattttgcattattagtttttatttcttcagctagtgaagttgggcattttgtgtttgctgtatgtattttacggattccttattgacgtctttggggtaaggttctaaaggtagagaaggcccctaccatgcatgtgggtggaaagcctgtacctgggccttctcggcactctctctgcatagctcctcctgctccatggagtatttccacatagggtcggatttctttcgtattcttaatttcactttgacacttgattcatcctcttttttagagactttggttattgttgttctaccataagctccatatactgtttggtagtcccaggcatcagttctctgtgatgagaggggctgcaggaaggggctgcgccagctggcagcacaagggcctggagtccgactgcaacagtgagcttgcacgcggaggtgcacggagccagccaggggatagctaggtattttttctttacccatatgaaagagcacttcacataaaacggttttcttttcaaaattaaaaatgtttagaagtatatcttttttcttttaatatgaatgaggctttcaatgtagttttctttcttttcccaaaagcttccaatatacctgcaaacaagctttatttagcagaacttttcccaagaacccagttcgtcactgccagactgcctctacctcggggccacagaaaaaagtaccgtagaaatttctggaaggttggggatttttgcatttttttttttttttctgagtgcagctttaaataattttcaagaataagaaaatacagtaaagctcacttggtggaacacaggagttttgtgttctagtttaagcaaatagtttatttgaaaagtgttagcgagaggatagaaaaatgtttatgtgcatgagaagtaactgcaaaacgaaatttggcaaaagtttctcattttgaatatacataggaaagtcataacagaaaatgaaattaagaatttaggtatagttgtttgttgttcaatgaaaattgtgcctttacaggtcaggatgagaatgggagggtcattctgaatcgaaagaatcacttgttttatttggcaggggagggggagcagcagaggcaaatggatggtaatgtggggaggcgctcatgggtcagggctgcagccacttccttagaagcagcgggaggaagggttggagccatttaactgcaagaggaaatggtttctgttctttgagtactctgtacagtttgggcttccacttttagactaacctgtgaagacagaaaattacactcacactggtaatggagagcttcctaacttgtttggtacaattttcggtcataaaacaaaagcaaaacatggtttttctcttatcatcaccagaaaagggagattgctgaagtgactctcagctcagtctgggagggagttggggctggaatgagtaattaaatgtgacttaagcactttcttgtcctcagggtgggtgctttggttttaggaaaattgtacttacttataaaataggggggaagaaaagctaagaccagctcattattacttcaggtttgcctacattttcatactttggggaattggtaaatattttcaaaagatttagagaaacattagttctggatactttttgttagcaactcttcaacttttcctgtaaatactgtaggtaaaaagatattatggtagcaattatgagataaattataggttcatgaaattatgtacttgaactatattttcatcttgccgtaagtgtgttggttttacctctttctttgaaaagacatcatctggttacttggagaattctaaaataaggcttttaggaaaattgtatgtatttgggaagttatattttgttgtattatgttgctgtagccgttcattaatttcacttgaattctaaagctgccagagggaattaacaatttgtgtttgaattcatcctggtagtgcttatactgactccgtgcgaatgaccttttgtcactgactggactgttactggtagtatgagagtgtcacaacattgtcaatggctcccaaaacatagaccaaaattatttttggaaaaaaaaaaaaatactcccagaaacggtaaggttatggtgctttttgtaaacattaagagaaaggaagtcagttatcccgctatgataaaatatttaaaacaaagagaataaacagtgttgtataaaataacaaattttatttctagaaaatattttacactaactgtgcacatgcacacacccacacagagcttaaccacacatggatttcctttaataataaatctaccacatactattatattacaatttataatagcgtttttgaagacacaatggggaaagctttgtcattcatttataaaccgtccataaattacaaaagaaaggcagtctgaaaagtatgtataaagagtaaaaacaatttacaagtggacaagaattacaaaagagtaaccatcaaatacatctgccagcaactttgtaagtaagtcttttgttcaaatgccaatgatgaagatgggtatggactcatttggagcagatttaaattgagtctggttttggtgtggcttatgcattatgtggattacttgtgtgccattcattgctgtgtatttgggtatggcattttgacaacgaaagtaacagaaaaccatatgccacagaatagaacattaaaagcaatgaagataatcggctttctggaaggttggagtactggtgctttaccaaacaaagttactttctctccttttctcttttttgaatgattgagtaaacattttctgtgtgtagcctggctggctttgaaagactgaaactagtatcttaaaatgcacagcctgtacaacttgatctcaaaccactgtgtcaggatgaagaccactgaatgcacgacacatacaaagtatacactgtttttattagacagtacaaatcattgtgcatttataaggcagaacatcaaggcgaattaaactaggaatttcaagaccagagtcaaagtgaaagttatgcattatgaggcaagcattttgagaagggagaaaggttgaaaatcattcctttaagggcagatgacaaatgcacaaagactggaattacaggtagggagggagctacaggtgatagctatgcgcccccgtttgttaataagacgtcccctcccacctcccaaatcagagcttggacaatgagagcagactgccagcggtgacagagagcaaccgctcctctttgttctcgtggttggtttaaagtggttggtagtgcaaaagtgcatttctctactggtgtcaggggagaagattgggtttttttaggaagtacttgagtcatgaaagccctagtttggaattaaagaaaattacatagatttggcagttgtccggaagcacatgaatcatttcactgcacccagctttttcagcagtttcttgcctttggaaagcagcccctttttctttttcgaggacatttccctgcctctcccaggactaccagaacccatagatgacgtaggtgaccccgaatggagatggactgtgggggatggagctctccttgctgtacctgaaccctcaggaggaacctagtaggtacagtgttacagtttattgagtgtgtgagcgccaacaacagaattcacttggtaacatcgtactgtccccgtttcccaccaggaaaggtcaggggggttcatttgttctttcagttgttgaagtatgccatgagaagcaaaggtcctctcccacagcacgccagagagaggccccagacataaatgtgtgggttccgtttctctgtctcgagggagtgcggggtggccgttgctttggcaaagctaaggcaggtaataattcacttcataaatgaagactaagggcaggggagacatgatctgaaattaggttgatagtaaagttggccgagtacccatcagtagtcttaaaaagcgaaagttcataaagggaattttgttgtatttgaaactatttggttatataaaatcctgatattgttaaagtgcattcctggggtggttggtatactatagaaatattggagatggcacactggttgaaagaaaaaaaaaaactaaaatgaaccttaattataatcaaagaaagcttaaaggcccttagtggatgcttgcattatttccaaataattgaacatgaatcttcctcagtagatagcacatggtagtatttaaatatacgttaagcgcttaatagtgcttcagaggggtagacttttactctaatacgctgcaggacgacttcacctcgcttccctttacagctaagcatgtgcctgagttggcagtgcagcagcattcctctggccctacctctccagagcaactcttgccatgtgagtgtttagtattcagcaggcaaatgctgtaagccaaggggcttcaagcttgcttggatttaaaatcaaggtctaattctaatggaaaacacctagtaaagcatcccaaagtacacctgaagataccatctattccatctaatgtgatcatttgagctgcgtgcttcatcaacttagtattgcattggtataccaacaacaaacgcgtgttgcagcaacttctgtcacaggatgattgtgctttgaggaggagcatagctctctcgtaaggtagaggcagggttacttaaggaaaacacgttctggccactcgagccagtgtttggagtgttcagagccaacactcgatcacctgtgttcactactcatctgcttgaccttgggttaagtttctaaagtaaagcttcctatagtaaacatgtttgttaggttgtgctttttccaagagtggctaacaatgcaatatgcagctctctctatgtaaacacacagttagcttgttaagaaatatgttcccaatgttggcctttcaaatattcttaatgcaaatagtaggaaatgattattaaagatgatttgcttcactataaattcagttgctttacaactgagaccaagtaatattctaattatttaggtccaatagttttttgagacatatttctttgtatctttttttttttttaaccccacaatgaagccttaagtctaccacactggcccggttaaggtagcttaagttggtatctttatcggtatcttcagttgctcacttacgtgaaggctacattgcctgattaaggtgtgaaatgaacactcttcttctgtttccaagcagatgagcaaagaaataaaaatatatatataaaaatataatatagaaaaacttgcagtgatgaaataaaataaaaatgagatactaaacatgaatgtagtctaatagttcaatatgcttgagaagcccttggatccttgtgaagagactaaagtcctaacagagggcaaataacctccattgcccaccaaatctgaagaggagccatccccttttcactcttgatcaaactgaaatgtgcttctataatgtaggatgggacatttctttgtgagtaaaggcagattgattgattagaattgaaagggtctttttttgtaaaatgagtaagatttagaattaagaatttttaggtacaactcccatggcttcagggcagagaaaaaaaattcagggtgtatttacgcttttcggcccaagatataaaaatatcagtgcaaagattgtattagaccacatatggcagaacgggacagagattaaaaaggctaaataggtttgcttaccctttttgcctttgagcgcattggcgtatcttgagagtagtgggatggagcatcagaaagatagacttctacgtcatcaggcacttcttccaagaagtttgagggcacaaggcctttctgcccattcagctccccctaaaacaccaggggtgaggcagaagaactatttatttttctagaaacccacatcttgctttggctaaaggaatacagctcagagtacaggtacatggtgagtttattctggttcaaaagtggcaggacttgaaaggactctaaatcagggtttccaaattttcctcagcaacatgcagagtcctaagcccctttcctggggtcttgatttctcctgttcagtgaggagctgaggaatctgccttttggccaaagagcccctgggattcttaggatcaggcttctgaaggaaacactccttggcagatctcatttagtggttctcgggcctggctgatctgaggcactagggagctgctaaaaacacatcgctcagcacaccagcccagaccaatgatggacaccttcagacggtggggacctggtggtcctaacatgccagcaagcttgagcgctactggtctactcagccttaagactgtcctccctcttactcatggataggttattatcgtaaacattcaaacaatatggagaaaatgaaagtgtctgttgataacctcctcagacattactgcttcaggttggtatatatccttccagatctttctactcatttacatatctatgccttgtctaaagtcgagatccatgagtccatctgcctgctggtcatctgcaccaagtggctcacaggcctaccacgtcacttcttccccaaactcatctgcccataaagtgcctaaaccaagttcaaaattggctggctctgggcaacacggaatcctgtttctctgtttatatggtctaggaaatgacataaagagcctactacatcaaaacacctgtgcagtgaaggacacagcagagtgatgagtacctgtggaatgggagaaaatgtctgcaagtcatctatctgctaaggggttaatatccagaacatataaagaacatcaaaaaacccaattaaagacatttctccaaaaatgagattcaggtggccagcaggcacatgaaaagatgccagtcaccacgaatctccagggaaatgcagttcaaaaccatgtagtaccacctcacactactatcaaaaacaaaatggaaaaaacaggtactggtgaagatatgaagaaacgaatactcgtgcacttttggtgggaaggtgagatggtgcagctgctgttgaaaacaagatggcagttttgcaagatggaaagagttctgtagacggatggtggtgattgtttgcacaatgtaaacatacttaacactactgaactatatacttaaaaatgattttatatcttttttttttaaattgagacagagtctcgctctgtcacccaggctgaagtgcagtagcgtgatctcggctcactgccacctccacctcccgggttcaagcaattctcccacctcagcctcccaagtagctggaattacaggcagatgccaccatgcccggctaatttttgtatttttagtagagacagggtttcgccgtgttggccaagctggtctcgaactcctgacctcaggtgatccacccgcctcagccttccaaagtgctgggattacaggctgaggcactatacctggccaattttagataaattttatgtagattttatcacaaaaattaattggaagaggcagccccacatacttcctgcatcttcctgttcagcaacgctgccaggtgcacactcactgccctgccccgccccactcttctgcttggaccttgaaggtcctactcttatttacctgtgactgccctgggccttctctcaccggctccattattagcttatttttctctgttgacattacagactatttctaggccacctatcctttttactgtgcatgtgcccctggcgatttcttcctatcgagggtttttaataacatctaaatacgaagacactcaaaagttataaccagtcaagtcccccctcattaggtccaacagccagatttctctgccagccttagaaaagattcttcctctggctgagcaccagatggagtagttggcttatatttggggagtgtgttctgtgaacacacacaatgttatgcacacatctccgctggtgtcatgctcacaccacaagaggcgtgtgtaccccagcctgcagaggctcctgtagagccaggcctccaggccagcccctgctctggctgagtagaatgtgggtggaactgcctgcactggttattgctcttgttcttttgggctgaacacacacagccctagtaaaatccacgtcagaacgcacatgtaccatgtcactcccttccccatgtctgatgcctctaccactgcgtgctactgcgtccaaagtgacgacgggacttgctcgcggtgtgaatactgctttggcctaagttccgttctgtttggagaggctcagaggtcctgttcacacccctcaagctcaagagtttctaagccaggttttccattcaacgttgttcttatccttgcgttctcaagggcacccatcacctaggtcagaatcgaaggctcccccagacgacattctctgtccctctgactggcagtcagaacgctggataagatcatcttgagtctgccttcccctggtactgacgtatttcgggccatgtttcctgcctggagggttccatatagcatgtttcccagcctcctggacccactcccatcccccttcaaaagtgtaccatcaaaaccctttacagaataactttctctaaaaaaatttcaccttgacctttccctcctcagtccctccataatttgatctctgcttctctcctacgcctcatttcccaccatttctctatttgcggccaaacagtaactacctggaggcctaatgtccagacagaatgggaataggctgaaaggcagaaaacaccaaaatcgatcccctcccagttttctctgtgccccagtcagtgagacatccactcgtgtttgcacactcctctggattatctcccgtaccttagtacgccacgtgatggcttgcttttgacataggaaggtacaggatttaaggtttcagataccgagatgctgggctatagcaagaacagcacacgctttaaaacacgatggggtgttagaagtcttcagtgacttaatgggggctgatgtaaattatgaaatagcaaaaggaggaaaaggccagggaggacagcaggagtccctcgggggtccctgcttacgcttgttttactgatatgggatatagcagaacagagaaagaggagggtgatattacaatattaggaccggtggagtatttgaattcgctctctcgagatgtttaaggttacagatatcaaaacaaagtaccaagaaatttaagatttttggtatcaaattaggtgtcccctgtcattgtttatcaaataagaaatacttaaatgaactgggcagtccgctcagtgaacatgaccagcaaaatcatagtaaaaccatttggaggagtggtaaataaaaagaagcatacgtttcatattaatttagatctgattcccactataatataaaaacttagggaagactattcaagaaactaagaagataaaacataactggggaatagaaacatgcagacaaattagaaaaatcttcttaaattccaggaaagcccattgtttctacatgtgaaaatctaaatgaaaagtacattcctctgaagatatgtagattgttaaaaactgataagataaccatttaagcaaataaaaacttttgtgcaactgcagtctaaaaagatactgaacctaaaggatctctctctgggcagattctaataaccttcaaataatagtaattgctgtgtcacttaatctcctctaaagcatagaaaaaggttgaaattttcttagtttatttggtaattctagcataatcccggtatcaaaagctacaacaaaggtattccaatgaatacagattattattatttctggaatataatttctgaataaaatattagcaaatcaacttccagtgccttaaaaatattatatatgatggccagtaatttactgatgaaaaataagcagagcaaactaaaactttcttagcattataaaggatactttctccgtattataaagaccatctatctttactgatagtctaacctacatataacatgtaaaatatgagtggtattcctactaaaatacataacgagtcacagatttccttatctctgttattcagaatcgttctaagtgattagtaagacaattaaaaatgatgacaaattataaatattggtgaagaggaggcaaaataatgacaatctgtgggaacccaagggaatcggttgataagagaaataaatgcattcagaaaaatgatttgtgggggacatgtacacacacacacacttttccaacatgttttctaaataacagtggaatatatgctagggggaaaaatcattcacaatcataataagatctatataattcctttttgtttgtttttgagacggagtttcactgtcacccaggctggagtgcaatggcatgatctcagctcaccgcaacctccacctcctgggttcaagtgattctcctgcctcagcctccaaagtagctgggattacaggcacatgccaccacgcccggctaattcttttgtattttcagtagaaacggggtttcaccatgttggccaggctgatatcgaatgcctgacctcaggtgatcagcacgcctcagcctccgcatgagtcaccgtgcccggccgttggatctatatagttcctaagagtaaacttaagatatataaaggatgcgtaagaataaatctatgaatcttttctgacagatgaaaggaaaaactttttaagaggaggcgcatgctatgtcagaattgaaagacaatattatgtctatttcttccaaaagctaaatgtacatctaaacaaaaaagtataggtttgttgtggaggtgggactctttacaaaatgttccctcccaaacataaaaatgcattataaaaatacaataattaagacagcatggagtagtgttaaagtccataaatactctaagtattaaattcctatttacactttaattttaaaacgtattcattttttattattaaaaaatgatttttttaaagtagggaaagtgcagattatttagtaaatgtgttgagacatttgttctcatagttaggaaaaaatggtagatacttgagatttacatgtggaaagtgaaactataaaattgaaacaaaatgaggtgattatttctatcaccttgaaggaccttttaggcatgacccccaaggcagaaacatttgaccgcatgcaaacgtgaaattcatccttaataaacaacaaaaatggagaagcaaacacacacacacaaagttaaaaagcagaggttgagctggaaagaactatttgaaacacatgtgacaaagtatgaatatcctcaccaaaggcaaatcagaaaccaggcagaggagagagcctgggaatcctacacatgcctgcggctgtagcatgtttgacttgaagagaaacctaccgtccaggatgtcatcagttcttgccgattctgataaaggcggtgggggagcaggtggaaacacatgtgcaaggtggggacccccactgggctctgcgcagggtcctaagtggccctgtgggcttctggtcagggaggggcagctacttgtaaagatgccccagctgcggaaactctgagataaccccaccccattccctccctttgccccagggagtattcaagacatgctccaggggaacagaaaaggagggagggtggctctgaggtccctgccaggaatcaccagcagcaaggggtgggggcggggtggggggttccaagctgctaacagcagttggctctagaaaaaaggtaagggagaagtcctaaaatctgtggggttttaggtttttgttttgttttgtttttgcttatttgtatttcttccttttcctaaaatttatttttgacctatacagttaagtaatctagaaacttaaattgttttgtaaatgtttgggtggcagcaatttaaaaaataagaatatgaatgtatttgttttgtttacagtgcatatacattgaaaacactagtattagcaaggaagaaacaatgaagttcacagtcccaactttctagattatctataactcagcaaagttctataactcagccaattaagcaaagctatcagcaggcgtatgacgttcatgcccaattttaagagaaggaacggactagcaaaacaaaacacacaaaataaatgaaaatacaaaaatcaaatggtacttcttgatatttcaaaaacttacataataaaatccatcttcatcaatttcaccaaaaactgtaataatatctcctgtgcaaaatgtaagttcggcctgtggagatgaaacataaaattaatcgtatttttctacacaacagtagtagttttttaaaaataagttctctatgctttcccttactatttgagaatttctggtattaatctactctttcagtcaaataaaggtagaagctaatgaatggctctgtccacagtcttctagaaagtaagaacaaaccaagataatgtgcacctaaaaggaaaatgctgcagtgctttgattttggccaaaattcaagattattaccatgttctactgataatacatttttaaagctagtgaaatggttaattgtaaaaacctggaatattagggaaatgttctctgcagtataaggaccattacgtaaatatcctttcactgagtattttaaaacctactcaattattaatgaaacatctatttatttattgagacagaatctcactgtgttgcccaggctggagtgcagcagtgcaacctcggcccactgcaacctctgcctctcgggttcaagcaattgttctgcctcagcctcctgagcagctgggactacaggtgtgtgccaccaagcctggttaatttttatattttttatagagatgtggttttgccatgttgcccaggctggtcttgaactcttgatctcaagcagtctgcccacctcccaaagtgctgggattacaggcgtaagccaccgcacccagcctaaacatctctttattcagtgtctacgatgggccgggctgcagccccaaagcaggcggtgtcaaacacgccccactgccctcaggggtccaactgacccagcacatttcagttcccagtcacccagcagaacatggaagcagaaatctagacaatattcacaaccaaacacattttctttctaaatgtcaaaatgagggaatatagttggtgagccagtggcttgtcagagcaaagtactgtgtaacatgggttcacatacatcttgtcatctcagctagtagctgcagagactggagaccccacctctcatttctgaaggcagtggtttcagccttcaagacaccaggcatcccaagctgtgccaggcgacacaacctcacctatcactggtttcctctctactgttctatgtgtggggcctgactgctttgcttttgtttgctgaccacatgtgatgggcttttatttctctcctaaagatggccctcaggtggcatcaccattagatgtggatgacagattgttctttctgtcatggcacaggaaaatctgggccatggggacagggcttgtcaggggctggccatgtccctgggaatcccatgatttctctcctgcgtggccatgtctgtatcagccatccctcggatcggcagcccttcctacggatggttcggagagaaggaatgaggaggtgaacacacgtggcctcagtgtggtgtaccacgagggaagggaagggtgtggttgtgtccgtcatgaagtgcagtgtttggctggtacctcgacatcgacgttgggcgagctttctctggggtcgtagtcatacagggccaccattctccgcgtcgataccgaatgacgcctgccacttctcctgcttctctctgttcagatcacaagggggaaagaaatccatcatgaggttatttcaaacttagcggtgttcccctccttccgggtcacacatggccaatacagccgagacctggcactgctaacagggccacgtgctcctgggcactcacatcagcaaacgtctctactttgggtcagtggtctgggactccatattcttatatttttgctgtagtatggtttctcccccttagactaacatgaaccttttccttcctccagtctgtccattaaaccagtgagactcacatgaagcacggggctctcgaacagcaaatttagacggctttggccagcacggggaggccgtggcttgggaggccctgcagagtgcacggttgtgacattgctctgggaaggccccatagacacagttttaaaagtgcctgtttgtgtaactatggtggcgctacaaaatcaagtcatgctcccctaagcataggcaaaactaaggcactgtcctcaggagaagcacgaacataaacagggatgccttctccacccagcccagtggcttccctcatgctgcttccctggcatccttccattgtggtttagcagcggccgtagagaagatcccagctctgcacagtcgacttagaggtgcattcccacggcctggctctgtctctgccacagatcggggcctgggcatcatcccagcacactcagaagcataagaaggggctgcagaggaattgccctaggctctgcccagcgtgagcgctccacacagataacaggtgaacactctcaggacgtaaggaggcctcagtgcagagccgcagaacctggcccaatcacgaaacccctgtcagactgaaggggtggggctgtgaaggactttcctcctggcgaaagttggcatttatgtgtttcttctaaacacagccactttttgcttacatttgatttggggaattccaaacatacagatgaaaactatcaaaggcaaatatctcaacggcaactaaagtcagcgatgtggcttttcagtggttttcagcaggtacaggggccagctgtgtagccctgcaacattccagcgattactctccccttgggttctggttaggagccactgctgtagtttacaggacgcacacacgcctctgtgcacatgtgtcctctgcaggacctgcacatgtgtgtctcctccagaggttcgtgtttctcagcattattcatgttacagggaatgttacaagtatgacttttgaaaggtggcataacaacatacatgtacttctcactgaagtcaaacttacatacacgaaggctcactcttcccagcgtgcagtactttacgttgtgataagcacacacagtccagaaaccccacaacaatcaagatatagaccggccatagtcctctgtagtcacttcagcccagatgaccacagatctgtttcctgtcccagaccttgaccctttccagaatgtcactaaaagggactcatacaaaatgtagcttttttttttttttttttttttttttttgagatggactctcgctctgtcgcccaggctggagtgcagtggcgcgatcccggctcactgcaagctccgcctcccgggttcatgcgattctcctgcttcggcctcctgagtagctgggactgcaggcgcccgccaccacgcccggctaatttttttgtatttttttgtatagacggggtttcaccgtgttagccaggatgtttcaatctcctgacctcatgatccgcccacctcggcctcccaaagtgctgggattacaggcgtgagccactgcgcccggcccagaatgtagcttttgagacaggcttctttcatctggatgacgcctctgagattcacccctgtcactggctgtattagcagtggctctgttccattgctgagtaggccccattgtgtggggcgccttcgttctgtttctgtcaccagctaaaagcacctgagttgtttccagattttgatgaccgttggtcaaaccactattaacaaacattcatgtacagtttttttgtgtgtgaacgtaagtttccctttcttctgagtaagtgtataagagggaagttgttggattgtattgtaagtgcacatataactttacaagaaaccagcgaactgttttgcagagcggtgatgccattttccactttcaccagcatgcacaggcccacctggcacactttgtgcccacacctgcgacggccagccgttttaatcttagccattctcagtgtgtgtgcattggtttctcagggtggttttaatttgtgtttcactgatgatgttaaagatcttttcatgtgcttatttgccacccacatatcgtctttggcgaaaggtcacttaaatattttgtacatatttttattgggttgttttcttattgatgagttttgaaaggtctttgtgtattctgaatgcaaatcctttttccagtgggttttacttgcaaggattttctgccagcctgtggctttttattctgcactttttaagtgcagagtatttaattttggtgaagcctaacattgactttttccttttatgtatcatgttttaatgtcctgtcaaagaaatcgttgcctgattattataaagttttctcctgtgttttcttctggaaatattagagtcttaatttttatacttgaaactatgatccatttttatttaagtttttaatatggtgagagtgtggttaaggttcattttggcatatggatgtgcagtaatgtcagcaccaatgattgaaaagagcatcctttctccgttgaattgcctttttacctttgtccaaaatcagtggactccatatgtgttggtctgtttctggacttcattctgccccattaatctatgtttctatcctttctccaataccacgttgtctcgattagcatacctctatagtagtaagcttgcaattagcttatgtgaatcttccaagcttcttgttcttgttaaaaatagttttggctactctagttcctttgcctctccatatacattttagaattagcttgttgattctacataaatcccagcacagatttcgaatggtcttgcactgcatctgtaggctcacttggggcagctgacataccaatattaagtccatgaatatgatctctctgtccatgtatttaggtatctgatttctttcctcagtgttttctgattttcggcatacaaatactgcacgtgttttgttagacttaatgctaagtagttcatgttttgttgtgtcattgtaaacggcactacttttaaaaattttaatttctaaattttcattgctcacatatggaaatagaactgatttttgtatattgaccttgtatccattgatgttgctacactccatttgttagttctaggaacttttttatcctttgagattccttgagattttctaagtagatttccatgtcatctgtgaacagaaaaagttgtattccttcatttccagtctgtacaccaggtgtgacttcccctcaccatgtcgccctggttatgacctccagtatgatgtggaaaaggagtggtgagggccgacatccttgtctgtgcctggtattaggaggatcacattcagcctttcaccattaaggatgatagtttctggcaatgcggcagggggcacatagatatatcaggctaggttcccttggccatcgacatttagaaaaatagcataaaaaattttaatctaactgataaatcaagttaccgttccttaacagaaattcttgtatactttctgggtctgtggtgtacagggcctgtgctctctttgaaagagtcttagtcaacttcgggaaaggagatcttaacaaaagtgagtagaggggataaagggctcaaagatcttcgatctcatggatttaatgtgggcgatatattcacactaaacttcgactattagatgtggattctgtcttgaaacaatgcgtttattaatgccaaaaaaggttgaaatgttttgattttgtgattatccttaaaattatgtatattctttgaagcacagaattttgtctttgaagtctgatttagaagctaatcaagttttgaagtattaaaccttaaatatgaatgatataaaactgatatctctctacagctttttagaaaaagcagaggctttttttgagactacagaggctttttttaatgaggacattgttattgcacgtggaaaaaaatttaaaactcataaatgtaatgttgcttaaaaaatcactgaaaatagttttgctgcattctcactggtgcttgcagactggcttaagataaatgaaggagtttcatgtctacccaaactaaagagaaaagagcttgtgcctcttggataagcaaaggtcacctaaagaatgaaaggcatagcggccccccaaccacccactgaaatttattgtagacaggctgatgttcaaaccgtattaccagaaagcagctaatcatgtgttttctagatgcgataaattgtttgcaagcaagacggtacttcatcgcccattagatcatctgtgtcttcacacttaggtgtatctgtgtccctaaagcacacaggagactactggcagtcctggttcgtagggtggcttttgcccaagaaaaatcactggtcaacatttacatgactttggcatatttaaatgatgcaatttggggtctcctcatcaccgcctgcctctctgagcggcaggtgttttgtgggataaaatgcacagggaaggtcgaataggggtttgcgcttacctattttctccacaggtgtattcagagggagaaagccctgtctaagaagctgatccatcatctcctcatcatctgcttgtatctcagagaccatgttacaaggaataaggccaagccgggcacaggtttccccacggtagaatccatcagcgtctttatcaccataaacctagagccaagggggaaaataaatcaagcactgtaattgattggttcagaaatacaatagtcccactgacggtaagtgagtgtagtcgaaaatatattttaaatatagtttaaaaataccataaatcacctgcataggtcacccacgtgtgtgctgtggatgtgtacatgtaaccctcgctctatgactctgacttaagagccagtttttcatctagtgtttggacaacctgccattcttctcatcaggcagggtgtttgcttggatgaatgcatgttatttaaattcacgcacattaaaagggtgtgtgatgagaccccactctaccaagaaggaccaggtaggctgcacaaagtggtgtttctgtctgcctgaaatgggttcctacgtaacaagatagtgccacatagcaggcattccgaccgttctcaaatgccaactgtcaggacccttgctgaaactgcaaacagggttcaaggccctctttctttcccctctcctactgaacagcacactttctctcattttccctacttgagactcacaaggctcctctcctctcagaaggctggatctcacggcctgtaatcccagcactttgggaggccaaggcgggcagatcacttaagatcaggagtttgggaccagcctggctatcatggtgaatccctgtctctactaaaaatgcaaaaaaatttagctgggtgtgatggcgcgcatctgtgttcccagctactcgggaggctgaggcaggagaatcacttgaacctgggaaacagaggttgcagtgagctgagatggtgccactgtactccagcctgggtgacagagcaagactctgtctcaaaaaaaaaaaaaaaaaaaaaaaaggaactgggtaccaaagggataggaaacaacctccatcaggtgtattaaagaactaaggcatggaactccagcctctagctgctgatgctcccttcttccctttttccctccctttccctctccctccttcctctcttccctgcctgtctgctgactgacaagtgttgttttaaaatttggagcctgtgttatttttctcaacaacgtaggccctaatagaatccagagttcacaggacatatttgggtgtgtttgtgtgcacacaaaccgggcagatgctggagaaggcactttgcagagggcagggcccttgccgtcacagcaccatgccacctcctcccgtgcctcgcccatggcctgcaggagaaggccatctctaagtcgataccctgttgccagtctctgcccccatgacccagacccgcctcaggggctgatgaagccgcccgcaggcagccatcccgcaccttgatgatctggccttctttaaagggaagctcctcctctgcagcatctgggtttggggacatggtgagcgggtcgtagtcaaagagagccacaaagatccgggccgggagctcttcggcaccagggtcagtttctgactcttcatagaagtctggagaaaggcggtctcgcccgtaatcgtctgcgagcaagtgggggtgaagaacagagcggcagtgagcctaactgaggagcgtgcacgggaaatgcagctttggaaagcagtgaggatggcagcggttccttgacttttgtcttttttgtgtcttaacatgtaggtggaaatagatcgggaggtctaggtcagatgaattggagaagcacataaccacagccacactctgtacctggccacactgcatgtgaaagcattgagacagggctgggcctcgggggcctcctcagagagcacaggctggggcaggggctgcggccgtgccaggggcaggatggcccatgctggggagccttcccaggacccacacactctgcaaaatggaaagctaagcacagcccacgtttaaaatgtttgtatgttagtcaaagtccatagaggtgaccaactgttcacttacgtaaatatgtaactggcaacaaatgcatccttattacagtgaattaataatttcctggtgaattgggtttcaactccatataccacccagcttccaaaagtggttcttttggactagaggaaatggatacattcctagacacacacaacctcccaggattgaatcaggaagaaatcgaaaccctgaatagaccaatattgatgaaatgaattcactgctgaattctaccaacatacaaagaagagctggtaccaattctactgaaactattccaaaaaattgaggagaaaggactccaccctaactcattctatgaagccaacatcaccctgatacccaaatctgacagacacaacaaaaagagaaaactacaggctaatatccctgatgaacacagatgcaaaaatcctcaataaaatactagcaaactgaatccagcagcacatcaaaaagacaattcaccatgatcaagtaggctttatccctcagatgcaagattggttcaacatatgcaaatcaataaatatgattcaccacagaaacagaactaaaacaaaaaccatatgattatctcaatagtgcagaaaaagcttgcaataaaatccaacatcccttcatgattaaaaaaaccctcaacaatctaggcattgaaagatgtacctcaaaaatagtaagaggcatctgtgacaaacccacagccaatatcatattgaacaggcaaaggctggaagccttcaccttaagaactggagcaaggcaaggatgcctgctctcaccattcctgttcaacactggagtgctatagccagagcagtcaggcaagagaaagaaataaaaggcatccatataggaaataagaagtcaaattatctctcttcactgatgatacggcatccatataggaaacaagaagtcaaattctctctcttcactgatgacaaggcatccatataggaaataagaagtcaaattatctctcttcactgatgataaggcatccatataggaaataagaagtcaaattatctctcttcactgatgatatgattctaaacctagaaaaccctgaagactctgctaaaaggctcctaaaccaatagacaatttcaataaaatttcaggatacaaaatcaatgtataaaaatcagtagcatttctatacaccaataaattgttcaagctgagagccaaatcatgaatgcaatcccattgacaatagccacacacacacacacacacaaaatatacagaatacatctaaccaagacacacagaatgtacctaaccaaggaggtgaaagatctctacaaggagaacgacagaacactgctgagagaagtcatagatcacatgaatgctaaaatattccatgctcatgggttagaatatcattaaagtagccatattgcccaatgcaacctacagattcaatgctatttctatcaaacttccattgtcattttatatagaattaggaaaaactactctaaaattcatatggaaccaaaaaagagcccaaatagccgaagtggtcttaagcaaaaggaacaaatccggaggcatcacattacctgacttcaaactatactataaggctacagtcactataatagcatggcactggtacaaaaacagacacacagactaatggaacagaatagagaaccagaaataaaaccacatgcctacaaccctctgatatttgacaaagctgagaaaaataagcagtggggaaaggactccccattcaataaatgctgctgggataactggctagtcacatgcagaagattgaaactggactcctaccttttaccatatacaaacattaactcaaggtggatcaaagatttgaacgtaagacctcaaattacacaaatactgcaagaaaacctaggaaataccattctggacatcagccttggcaaagaattatgactaagaccacaaaaacaattgccacacaaacaaaaattaacatgcatgacctaattaaagaacttctgcacagcaaaagaaactatcaacagagtgaacaacaccctacagaatgggagaaaatatttgcaaattgtgcatctgacaaaggtctagtgtccggaatctgcaaggaacttaaatcaacaagcaaaaaatgactccattaaaaagagcaaaggacatgaatagacttctcaaaagatcacatacaagcagataataaaatataaataaaaaatatatttaaaaaatgtataaaaataaataaaaatgctccacatcactaatcattagagaaatccaagacaaaatcacaatgagataccatctcacaccagtcagaatgacgattaaaaagtcaaaaaatagacgttggggtgactgcaaagaaaagaaacacttaaaaatgtatataccattggagggaacggaaattagttcagccactgtggaaagcagtttggagatttcttggagaacttagaactaccatttgacacaccagtgccattactgggtatatacccaaaggaaaagaagtcgtttcaccaaaaagacacaggcactcaatatggtgatcgcagcactgttcacaatagcagggacatggaatcaacctagatgctcatcaacagtggattgaataaagatgtggtgcgtataccacatggaatgctatgcagccagagaaatgaacaaaatcacgtcctctgcagccactggaggccatcatcccaagaaaattaacacaagaacagaacaccagatacctcatactctcacttataagtgggagctaaacattgggtccacatagacacgaagatgggaacaacagaaactggggaacactagatggtgaaggagggagggggcaagggccgagaaactcctgacggggcgctatgctcactacctggatgatggcatcatttgtaacccaaacatcagcattctgcactatacccatgtaacagacctgcacatgtaccccagtgaatccaaaataaaagttgaaagtttattttaagaaatcaaaacaattattttggaaatcctaatacatatgcatatatatacatgtggatcactaaacatcattagatagatgtgtacatatgtgtatatatgtatggagagagaatgggaggggagagggaactgacagataatattggtctgatcatgggaggtggtctcacaacaccatcagggaagcaagtgagaaacacgccagctggcagcagagagagcagcattgggagaagcagcccagtgtgagcttctgtcccagcacgaggaacacaggtggtgggacgagatgacacaggtatgcagaagagacaggacaggtggtggagaaagaaccaaaccgtttggcctctttcaccagaaaaaataaaacacgcagtctaacaaaagcactttggctgcaggaaaggttgaattttaaaatgcaatgaattgtttacattattgagattcagagtcttttttgaatgcctaatctaaaatgtcagtaatttctgccagggaacaaaccttttccacagcagccttcattaatttctccaggctgttatgattttgttgatagtccatgaaaaaacctgacttttttctagtttcaagtggtatctgagttcaatagaatgtgaagcgctccatggcctctacaacaggcacagctgtgcagcccctgctcacacccagggatgatggtggagaacagctgtggctgcatgagaaggacgcctgctttccattctgctggagatctgctggaggaacttaatgaccatgtcagtgtgatctagtgaatgcagttccaggtacggaaaaatgccagtggaggagaacctctggctacaccattttccaagcaagttctcagcacttcccagctgagtttatgtggcaagtttgtggcatcaaaacgtgcagaggggtcaggggctaaggtcagattctagagagagttgggtgtggtcaacataccccttgaaaatctttcaggtccctcctatagcctacgtaagagtgcattttctcagtaggtggcttatactcaaggaccatgatctgtgaaaacatctttgtgtcttcaagtccaaactcacatggaccatgcaactggccacaccacgggaggcatttaggcagacaccccaacacagagctgcctgaggccagtcccccaacgaaggctccttccagagaactgcccacaatgtcacgttgttttggggggaagacaggtgtggggtagaggtgggtggagcacttggagttgaacgtatgtgaataaaatcagcgtatgcggtgactccaccgtatgttcttccagagaggatgcactggatgtgttatgagcaccaaacctcgacagggaaagagtagcagcctccctggaatgtgtccatggaaacttggcttcactgcagactggactgggcagttgggggtcccttgtccttggtgatggcaggcgagactgaaagaagcacttacctacagctgtctgtctgaccctggggggagtgggcactgcctcccatcctgctgaggaagtgtgctggcccaaggggtctttgttaggaggaagggtgtgcatatcgtgtgggagatcagggctcatgcctggacgcctgggtgggctcccaaatccactggtgccataagaataagcaccgtcttctacaggagagaggtttccctcactacctggcccagaccgactgccctcactgctactgtccgttgtaatttctatggagataaagggaatcatctattaaacagagttgacagcttttgattttttttattgcagggaaacctgaagaaaagagctcccctttttaaggggcaaagctttgtcaatagagttactaatgtttttatttttcctccctggacacaaagaaaacacgctggactttcctcactttgtaggctcagtagccaaaataacaaaaaatgggagaatacagaggagatattcagagttgattcctaagaacagaatcctcttgaacgtggtgcttcggttttagaagagtgaagctacaggccttctgtctgacaggtcaacaactagataaatgcaaagaccaaaagttataaaggataaaaatcaaacctaattaagtatatatttgaagccacataattttgttttttaatcatgaaggacattttttaaattttggaaatccagaaaatattaaaatttatattatttttcattgtaggtccactgcttattaaaaataggaagtgtatggtttacagacttaatttcctctgaaaaagataagtaatcctttgaaatatagatttctaaaatattgttttctagtattttcacaagaaaaatagaagtaaatgacaactagaggaatatcctgtctgttcagctgtcactgatgttcatttcccaaagctctttgccgagtcctcctcctcctcaggtgggtgataagcaccctccgcttctgtttccttttgaaaccataataggtgctgagatgtgtatttgtgtgtaaagtatctggttagagttattttatgtggtgtcccggcttgctacatgataagaagtcagcacaattaaagcaaacctatcataggtttgtcagttaactcttttctgagttatgttcagaggctttttccttgttaaggtgttgacatagatttgctctttcacccaatttaacaagtgtgctactgaaattaagacacgcatgcagcctttggaattctacggcttcagaaaaatccaaccacattcatcaaaagtagtttcatttgggaagggtttttatgatactaataaaactttaaagcttctcactgctgatgaatgcagttttaaaaaaaaagtctcaacaatatacagccatttgaaaagcaatactgatctaggaaaatagcaaaccaaagcggagacaaaaaataattatttaagccaatattgagtctaagtccaagcaacaagacaacccaggacagtagatttaaaccagactctgacagcgagggtcaccctggcaagactgcaggcccagggttggttttcttggacttcctggctcaagtgctgatttgtcacagcacaattttcagttctcagtcctaggagactggagtagaagacctaccatgcctcttccaaaggacgtcctttctgagcgcctacagcattaacttctcagcggctacaccatccccaggtcacttcctgagccatgcttgcagtcttcactcattaaagttacagtcaaatgaagactcgaaatctcaccctaaccacagagagagaatgagagccttgaacagggggattggccttttccccacatcgtttctcaaggcaggacatctcggacaggtcatttaacatgaaagccaggagaaccgatttattaagctccatagtccctccagagggaacgacacacgaattgaatgaagatttgagagacacacactaggtttagaatacccgaaaggaatctgggctccactaaccctgctagctgatctgtaataagtgccatcaatgttctgtgagcctgactgcatcttttattactcagttaactgaaaatacggtttcctaaggatctttaacattgcatgaaatttttaccagagaaacataaacacaatctaaaagctgtgaagatggaatttttttcttattgtttgaattgtacaaggaagaaaaagtctggcaggacacaatttcaaagaatctgttttgctttatgaagcctttcttcattttgaattgatggaaaagaccaatggccttttaaacttcagctatttcaacgagattccaggtggcttttcagtggcctagactatccagaagttatcctccttgagccctgtcatgccaaaccaagacggtttctcctcatctatttctgctgtatcaagagttctccctgcatttatatgtgtgtgtgtgtgtgtgtgtgtgtgtgtgtgttttcatagaagcctggttcctctgtgctgatgaccagcttccattatcttgtgcataatactttttggaattctccttgccatgattgattccaataatagaagtatccccctccatggattgattaggatgactaaaacgatagctttcagcatggctggctgaattccaaaaagtcaggaagagaatggaaacggaatgccagatgacgactcatgagcaagggaggtgcccagatggatgtggggagcacacatttcaggggcacactcagctgcacggtgtcccccaggatttagctctgctgccagcgtgtcttctgcagacaggcagcattccctcgggtggggctcacagacccctgaggcacgctgacatccagcttctgcacctgccatggactgtgaccctgagtgtcccagggagcccatgccaggatgagggaggtgacacaaagtggtccccccttcagtgcttaccctgtgaagctctccaggaaaaaatcagctgggagaacatggatgtagaaggccaatttgatatttcaagaatacttacaaatagctttcatttatcttgtgctgttcctgccttctttttgccatgaataacagtgttctttgcttagcggaaaatgctactcctaaagttttgttcatgcttagatggagtaagcagccacatgctccgcggctgaaagacacaacagcgatgatggggccactaaccgatggatgggactgtcacgggccgggacctctgaggaccagcgctgccacggggaaacctccggcccatgtgatccacccgtcctgcagaggctgggttccctaaaatctaaagacaaaacaacaacaaagtcgtaagtctcgccagcattgggaactgaagaattcagttagccaaatcaagcgggttgaaaagcagaatctgtaaaggcaactaaacttagcttttaactgaaaggttagctgaatggcctgggagagaacaaagccgggcaccagcaccccactgtctactcggagccgctgctgggcgcatggtggggtgagggcaaaaataattccttgtgggggggtctcttttggttgctgctgctggtgctgaagacaaatgttttgggaccaaagagacaatggcttgaatacatcccaccccgccttggctccttggagcacctgagtccctcttagtctccacatgcccccctcccagctgtcacgaaagtggggaagatgttgcagttcctcctgtcctgcttggataaaagtcgtatgtgaggtttcaaaaaactgaaagacggaagtttctacattttatcagcttcaaaactcaacattctactcctaatctgaaaatgctggtaacattctaggactcagacgggtctcctttctggctaagttcacctctaaattcacctttagatcagggttaggattgactaaagacaatcacagcaaaaccttcttcttgctagtaagtaaatggagtgaggaagttctcaggaacacaggcatgaatggtgggaagggagtccggggatgaggcgtgtctgctgcagaacctgtggcagggcaggggaggctgcgggctgccgtgggcggctgagtcactgaggcacggatctcgcacctctcctgggtgggcccatcgcaagcacacggcctcagacccaaggcctggcgccatgtggatggctcacctgtgttttcaatgaaaaggtcagcatgacaggagcaaatgttccgaaaagaggacacaatatagagatgaatgaagccttcaatgaatccctatgctcaaaaccaacaacaagcccagacggcagggccggcggggagaaggctgatcatggaaaatttgttctggaaactgtgggcacagaaaagaaatgggaaaaaaacaagaactttggaaacaatatgcaaaaaaaaaaaaaaaaaaaatagatttcttcaatctttttttttttttttggttataaatgtcagaaagcaatgaaaaaaactccaaaataacaaggaaaaaaaaccctcgacaatactagtagtcataaataaatccctaaggatccctgtgaacacaaacatgttgccaaactttcagataatcacacttcagctaacccttaattaaaatttagattcagttgtcctttaattcaagcagccatactcattactgattctggggggtggaaatcattactctaagcacagtaaagaaatcttcagcatggtcaaaaggttgggaagcaaatcggacttgagaaatcaaaaatgcagggaaaacgaaagacagccagcaagagagtccccagggatggacaccagaacaaacagaaaaccagtgaaaggatgggacagattggtttggcaagcggctgtgaaaaggaagtttaggtcacacaccagggggccttgtgcgactctgggaggtggctttgcgtggggggcagctgccctactgtcgggcatggttatgcttttcttccagacaccccgaaaatcttggtgctcggtgggctcgccccagccgtgcttcctggggggcggcctctccgggccgggctgggggtcgtcgttcctgaggaggccaccagggcccacctgctccccaaagtcctcctccacgctgctctgccgggtcagcgtccgccgccgggccagcagcggcctcgggcccctcctgcagggacagtgaccagggcctgggctgcacgcggccacggtgtttccgaagccaaaccgcgactcgtcctcttcactcccacagtccaggccgctgtccgggctccgggtggccgagcggctgaaccgacagcccctgtcttccagaaggaagtcctccacgtgggggacggcccccgagcccctgtgcttcaccgggaaccaggagccccgaggggcctcgtcgcccctgtagggcctgccgggcctgggctctctggccagccccgtcctggccctgggggacggccctgcaccctgcttgtgtagcagcccacagcactctccgtcctcttccgctacttcggggatactgaaaagtctcttcctgtggggctggtggggaaactcgggctgctcccagaaagtgccttccgaggtcctatggtcagtgcagtccttacggggtggtgtgtcaagaacaggcgcgggaaagagtgtgtggtcagcatgaagtgggggccaggggaggaaagaaaatacagacagaattagtcctggaggcaccgaggggggggaagcatgcgtctactcaggccgggggcatgccgtggagggctctgcaatgaaaacagaatgggttacggggctggggcggggtggaggctgaggcagagcacacgcagagccagcgggccgggcaggagccagcgccatgcatccagccaaggagagggcaggtgagatcccggcggcacatcaggccccacagtgcccacggtaccgctgctgtagatggtgggtgtggccacggtgccaggggagactgcccgggggctacatcctcagaaaccctgagggcagctgccactggaggccgtgtgtgactggagacagttcaccagacacggagcctgacccgtccctgtccatccactgggccaacttcccttccagcgctcggcaccctctgcaggactttctagttaggctgacgtgtcacccttctccctaagatacaagctgcgtgaaaccacgccatccccggccccaccaacagcgcccgcacaccatcgtgcagagtctgtgtcagcaaaggactggggtccgcctgtctcctctgcatcctgcatcaagtccctgagagccacacttgagccatcacagtctccagtgggtggcacagagctggccacaccgggagctgcttaaccagaccagtgtccatgacttttatactgcccgtctgcacgccatcactctctgccggggacagccctcaactcaccctctacccaaagagcatgaaggactcctgactggtctctccttcaagggggcttggctgaccgcccaggcaaagcgtgcccctgggtcctggccgtcggccctcgggatgctcagtagagatgagccacatgggcacggaacagggccacttgtctgtcccccctcttgctgtgggccccttgatcttggggaccatgtgggatttgcctaacacagggtctgccatgggcctgggacttgccacaagccaggtgaggaggcatcggggcacacactgtgcagctgatagctctctcccttcactttgcagattcgggagcacatcagctaatattggagcgaataaggacatcgaaaacaaaccatccttagaggacagggatggcaaccccaggcactttccaaggcaggcgggaatgagtgaaccgggccagcgggggccgaacatctgccgtgcccatcagggatccggctccgctacagctcctcactgccacgtgagaacgtgtgcgctgagtggccagatctctgtaccacatcttgtaatttctaaagagaacccagaaatccagacctgcctacatgatttctattttttttttttttttgagacagtgtctcactctattgcccagtctggagtgcaatggcgcaatctcagctcactgcaacttctgcctcccaggttcaagtgattctcctgcctcagcctcccgaatagctgggattacaggcgcgtgccaccacgcccagctaatttttgtatttttagtagagacggggtttcaatatgttggtaaggatgttctcgatctcttgacctcatgatctgcccgcctcggcttcccaaagtgctgggattacaggcatgagccaccgagcccagcctcctacatgatttctaaaaccagacaacaccttgtggatgggagagggaggctgctgccatcctggccaagctccagccccggcgatccccctgttgctaagaggtggagggagtggggctgtgcctgtgggggtggggctcagcccaggaactttatgatgaactcgcttgaccctgggccaccttctgaggagagaaggtgacattatttctctactgagcaattcccgggctcttcctccatcaaaaggaaaggcatcagggggcgggggaagaccagctgcccgcctcaccgggcctgactcatgggcactttttcggagctcctggctctggggcacacagaggggtcgtggggtcagactggaccactccgcaaaggccagtgtgaatctgctccgtggtgtcacctgggagcggggacggaggagctgccggggatagcacgtgctgcaccatgcagggtttgcatagggatctggcatgttctttggtgacaggacatcccccaaggccctgccaggggcctttgccaggagaacataagtcagtcttgtctatgcaagtaggcaccgagttggcaggccagatttggatgagtcttctgtccaccattcaaaatgcacgccctctgttcctggagaaagcagtgctgggaagcttcgtcccgggggatttcctctccaaggcctttttcatttggaaaacccacaaagctcctaccaatggcttgcctttgtctgtctccccattaggttgggacctgaagagggcaccccttagcctagcacagggcctggtgcatagagctggtcatcccgcactgccctgcagagcacatgaatgcgggagtcggacgcactggccagcaaccgcagcagcaatgacaaacatctccccaaggccaggaccaagggaaagccacgtggatgggaaacccaccctccttggctctagggtgcctcgagctcaatattcctgcaggtaactgcccgtcgaccccttgctgatggcctctgccagagcagaagggagagggtctagcgggaggtggtctgagcaggtgcatggagcctccagcctgtctttgaggccggtgtgatcagatgtgggacacccatctcttccgacctcactgtgcttgacccctgcccaccaccaggcagggccaccatagtgccctcctttaaggagctccctgctgaccacaccgtcctggcctccgctttacatttagaggttgatgcacgctctctcggctgccgattctctcgagatgagacttaaggctgtggagggggttcttctttgttctattccccccacttcagttcctggcacagagctgggtgccccctggagggtgccaaatagattcctctaaactcctttacccagaccttttggccaagagcaagacaggagtgtaggtaattcccaaatgcagattcaatagtgagaaagaagcgaatccaaatccgagggctactggttgtagggcaaggcccctctggagcctgcctcaccagccccagcaaagggacgtggatggagctactctggggacggagtgcagggtcccccttccccagccactcaccttgagggcattgtgggacgtgccgctgggccgcctccttcccccatcttccagctgcatttcagaatacagctcctcctcgtcctcctccatgatgtctgagaggtcagacccccggctgctctctgtgtggtactcgtctccatggcaacagtgcggctgggggccaagaaaaggggctactgagcgggtggctcctcccgcatcctacaagaggccagattgagcttgccaaccctttccctgcttcgctgactcacggggctcacaggcctagagacgggcacagggtgtgtgttactcgttctggaaagtgaggctggagagaggacacacccactctctctgttgaagtggcacagatgggatcagcgcaggtctctcagctccaacaggtacagaaacacctgagctctggacaagatagaaaacccactggggcttacaagacacgcgggcagaatgtccatttctgggcaccctcagcttctccaacttattggctggacaaaggctccaaactctggtgacggtggggatcagtgcacaccaggtgtaccctggatccagcattgtgtcagagaggcagggggatagtggtaaggtgaggtgtatatgtaccataaaaagacacttaggcggggcgcagtggctcacgcctgtaatcccagcactttgggaggccgaggtgggcagatcacaaggtcaggagatcgagaccatcctggctaacacggtgaaaacccatctctactaaaaatgcaaaaaattagccgggtgtggtggcgggcgcctgtagtctcagctactcgggaggctgaggcaggagaatggcgtgagcccgggaggcggagctcgcagtgagccgagattgccccactgcactccagcctgggccacagagcgagactccatctcaaaaaacaaacaaaacaaaagacacttaggtttttaaaacatgccacgttgtctaacacacacgcgcagacactggcagacagcctggcctggcaggaggtggagccaccgcacagactgtgtgcttactccgggcccagctcagcctcagcatgagacgaagattgtgcagatagtaggggcactgggcggaggctgcggacagcagaaaggcttcaacaaaaaaagtgtgtttaaatgaagaggctacctggtaacatgccagcttggagacagcgacagccctggtggtctctcccagtgatggtgccagcagcagccgctgggtttccactcacagagaaagcacctagtcacgtggtaacggtattcaaagcaaagtaaaccttcgacaactcgaactacacgttctgatgcactcagattgatgaatgtaatacatccataaagatattctgtttttgctacatggtatcgattaagaacagtttattttgcggaggtgtggcaagacaaaggtattcaatagcattctgtgacgtatttatctaaaaaaaaatctggtttcaattcctaacccagatgaagatgtgtatgcattggcgtcacggtcagttcctggcctgctgagggaagctgcgtggggctgcgggcggaaggttccctgccccaagcccgtgagagggaggacgggaagggcctcggccgggcagtctgcaacaccagcctctcagctgcgccagccctaatgcttccaaccaggctccaagcggaaggcacgaaagcgaactgggtttaaatggatttaaaaggtgagactgggtctaacgaggccctcccaaggcctctggggagggactgcctgcaccaccgcacagtctcactttattcaaccccagcagtgagctaggggtcaactcctgggacggaaggaggtgtctggcattcgccagatgcttgaggtcagccctctctccattcttggaatagtgttctaagcaaaggtcaccagcatttcagtgagatgtctagtgactggctgaaggcgctcagcaagtaaacgacagggctgggaccagggtccaggtctgcccttgcctctgctgacagagaacataaccttagacactctacttggtgggtgccttctcctagggggacacgcagctttaccctccagtcctcagtggagaatgccagcaggcagatggccctccctggggataggggaggtgctgagccccgcatccagcaggaggcctgtggctataaatttcacttataaagaggctgaggtaaagcctccacgagacaggatttggatcatcactatagcaaacttcagtcttatcactcggcaaaccaccttttctctcgccaaactaaaaatcacaaattcctcttaaaagcctctttccttagatttaataagggtacagactttcggttacatgtggagcaggttctgggggcctagtattcagcatgggcaatgacggatgtactaattaacttgactgggacagtcatttttttttttttttttttttttgagatggagtctcaccctgttgcccagactggagtgtggtatcaccatctcggttcactgcaacctccacctcccaggttcaagcaattctcgtgcctcagcctcctgagtagctgggattacaggcacctgccaccacgcccagctaatttttatatttttagtggagacggagtttcaccatgttggcctggctggtctcaaactcctgacctcaagtgatccacccgccttggcctcccaaagtgctgggaatacaggcttgagccaccacactcagccatgctgacagtctttacgtaatgtgtacccacatccggtcatcaagacgtacacccggaacatagacaatctttgtcaatgaaatacttttaaaaatagataactaaagatattatttattggtacagtgagcatttctcattgtggacttaatgaaaatgcttttgtaatattgggagaatggaggtgattttttcagagcaaatgtcccagctactctcagcctcccttctttcattcattcattcgacaaacattcattgagcacctactatgtgtgaaatgctagagataccgtagtcaactaaaagtggaggcttccacccactagaacatcggtgtcttggagcagatgggatagcgccagggggtaagggctcatgtgacggggcgggcagcatggggaagcggatggtcagggaacacttcccgggttgtaaaactggcagtctgtgcaccagctcaacttcagtcactccctaccactgtcatgatgcgtcacctagccagacgccatctgtatgattaatgaatgtattctttgaattgaatcaatatttaacgttacttttaaagaaaatatctcaactgtaaatggaaaataagtatcacttattttatgttatattattatattattaacaatatatattaacaattaatatattgttatattattatgttatgaatacaacataaaacaatgctgctaaatattaacgctttttaaattttaatagaaacagacctgtttgctctgttaaaaaacaaaacaagcaggaaaacgtgttaatagcatgcttggccaaacagacttcctctgcagtctcatcagaaggagtgggaggccctcggaagtgcagagctgtgtttctgccgctgtgtttctactcttctctagaaaagtcatctcttgtagcaggtgtggtcatccagagctgggcgtcagcactggtggccaccagccacgtgtggctgtttacatgtaaactaattagaatgtaaactaatctggaactaattttatagaagtaaaaattcagggcctcagtcacactcagccccaggtggccacatgtcaagggctctggggccacctggggctgtggctgccataagacagcgctgaatgccgatctcaaaaaccagtgggggtatgggtccttcacccagagaacaagtgctccagcctttcctccgggtttgtaatctgagcagattgcagggaaggtgatgattcactcctggataggtgaggagaacgtggcacatggggaaaggcgtggaaacaggtcttcttcaggcctcggttcaatctaattccagctctgttaggagaccatctgcgtaatcatggacaaaaattctcaattctgtgggcctcagtttccctgtatacataaaataagagcttacgtttactgagcacttactacttgccagttgtgttttgcgtgtcatgtaatacacagaaagcctcataaaacctgtgctatcgtggcaggtgttgctggctcgacatttgctatggactaagttgtatttccccaccccaccctattcagaagttgaaaccttaacccccagtgtgactttatttggagatgagctatttaaagaagtgattaagattaaatgacatcatgatggtagggtcctaatccaataggactattttccttataaaaagaggacaagatactagggatgtacagagaaaaggccacgtgaggactcagggagaaggcaccatctgcaggcctcggggaggcctcaggggaaagaaaccagccctgctggtgcctcggccctggacttccagcccccagcactgtgagaaacagacttctgttgtttgagccacctgatctatggtattctgtgacggcagccccagcagacgagtacaacagtcaacagaaatcctatctccagaactcacccagggcccagcaccaagaaaaggaatcatctgtgacccaagagaccaaaacagatacctctttctcaactgagatggcccctaaggttagggaaataaaaggtacctggggccgaggggtcaaggcctggctggcatggctgctctgtaaattcctacgctgcaagaaaacccacactcttgctaaactccagaacaacaggcgctatgggactcctcctaactctcatttacaacccagaccacgcaactccaactgggcagaggaccggccttacacacactcttttctgataagcgactgtagacattaagccggtttcagcttaaagaggcttaagcccattttagcttaggctttgagtcgtggggtttaccttttggtggaaagagccaattccacctcattctaacactaaaacccgccccatgtgcggtgcacacagaggatgctacagatatgtctactcactgcatgtgcgtgtgactcctctcggatggatgcacagcctttccccaacctgaatgcatatggttctgtgtaatgtggaccctgtgaggcataaaaatcaccctgcccttccctcttcagagagagcaccctcagcacatgccagagcctctctcttcctggtctgcaaactgatgtcaccaataaagctctcctttctacctctgagccttcctggtgggctttcggatgacacatcactgataagccattcattggaagccagttcctgcctgggtggtggccatgtgacctcagtctgctcagcgagatgtcatagaaagtctgactggaaggaagtctggcttccgtccatcccttttttccttcttggggtgttctcataggacggtgtgattattggagctatggcagccactttgtaaccacgagagaaaggccaagagaatggacgagacagaactcagacccctgacacactgagagccaaaaatccacctcgcagcctctactgcagactccctgtgatgtggggtaattaaacgactttgttgtcttagccgtgattagttgggcattccgtttctgaacgatttggatcttccagatgaagaacgtcatggccggaggagtcgggggacttgttcacctgtggtctgtaaccagccgggacataaacccaggcctgagagatgccagtccccctctccgggtatggggctgttttgctgtgggagtgggttcagaggatactgtgtgatctgataactgcagcgtcttcgagctcccactatttagcattccccaggccctcggttatttccagtccctcctgttgtccaagttttgttctttacagcatctgagggcatttccattagaatatgcacgatcggaaattagacagaaaccccaaactggctgaatgtcttcctcatgagcccagctctgccgttttgctgttctgaaggacgaacactgactgtgttatttttggctcccatgatgcctccctagcacacagatggccaacaaacatctgcccagttaacggaggtgaatgagcgaatggcaggttctgcctgaactgagcctaaccctacccggacctgcaaaaccacccctatgaccgaataccaggatggtgcagcgggggagggtggaagccctgcacttcgactttttcaattatccccaatgagggtatgtgacaggcattaaatataaacttcagaaacctagcacgacttaggaccccagctgggcgtctccatctctctcagggacccaagggtagcggggaaagtgcccatgtctcttgatctccacggggcccgctccgagcccgcgcccaccaggaggatggtgtggggcccggcccgctctcacctgcttgccaagttcagagcctttcaggaagtcgtccaccgaggcgcccctcctcttgaagtctggagagtcataggcgtcctcctcgtctgaggcggcgtactgccccgcgctgcttctctctaggaagacgctccttttctctaacttggaaagaaaaaggaggcacacgggtgaggcagggccaccttcagctacgctcagccccacctgcattcaccaaaccttcagcccctcagagcctggccaggcaccccccacacagtgctttgggcccagctctgccgccctctcgctgccccagacccaccagaatctttttttttttttgagacagagtctcactctgtcgcccaggctggagtgcagtggcatgatcatagctcactgaaacctctgtctcccaggttcaagcaattctcctgccacagcctcccgagtagctgagactacaagcatgcaccaccatgcctggctaagttttgtatttttagtagagacagagtttcactgttggtcaggctggtctcaaactcctgagctcaggtgatctgcccacctcggcctcccaaactactgggattacaggcatgagccaccgcgtccagcctctttttaacctttgaggtaacatttggatacacagatgactcctcattccctccattggtctcctctgcccagcttttattaataatttgatcaattcacatttgtctgaaacataggacttggaagtatttgctttctctcccgccccaggcttccctgccttcacagccttcttggggacctggagcagaagtggagccgcatcccacagggcagctgctaccccgtcctgcccacggcctccccagaagcaccacctcccaagctcagggcttgggctcctgcctgtgaaccaatcagagccatggtgaattcacatattctgaagggcttcctttatagaaaggccacaaattcatgtttagtatttttattagtggccaatgtcgaacgaattagcaaatttcacagaaaatttccagtttttcaggaggtgctgaggtgctgccggggcagccccactcaggaggacggggtgggggcggaaggtagctccctgcccagtgtcaccatcgtcctttctgtcctcctagacacacctgagctgctcagcattgacctctcacagtgcgtgccccgcctcggtttccctggcccggcccccagcccagaggaacactcacaggaggacagtgtagggtcccggtgagaccccacaggctgacccagcagggccgagggtcctgaccagggctgtgctgccacctcaggtggaaacgggctcaacacaacaggagagatgagagcgggttctgggtggggatgcgggcacacgttctggctcccagccccacatctcttcccctagccctgcacggggggcattgctctgcaggtgatttctcaaaaacgcacgtcccgttgtgtgtatcatccggaacatgccctaccacaatccacatgctctctcctggacccagaaaagttcagttagcaggcatgcaaatatgtatgcaggggtctatatgtccgtatgcgtttctacacataggtacagatgtatgtatatacatgagggtgcatacagatacgtgtatctatgggtgcatgtccatatatgtatagacacatatgtgcatgtgtgtgtatatatttacatgcacacacacacagaacctaggactctgcagccagcaaaaccaggaagagcctggttcaggaaagtgggtcctggccaacttccaccgggcaactctcagaccccttgtcgcacaccaaggccatgtctggattcttctgagcctgctttctaagccaggcaagtgcctggcatttccttagttatgtggctacatattagcaaataaaaaacaccatttaactcagtcaggatcaggcacatgacagagtccaccagcaaagcggtgggctgagcgcggcccccctccctgcaagctgggatgcgggtccccctccatgggctggggagattacagggccccgtcccgtggggtttggggactgaggagccaccgaggcgggagccccagccttaccctgctgctctcggccaccctctgcgcggcctcccgggccatggccttggcgacggtggtggacaccggggtgccctgtggctgtggcaggatgcggctgggtgagggcgaccgccttccggggcccacgggcggctccagcatgtgcccatgcacagggccaggtgcacggctctgctcccaggcctcatccatcctggcgtggggacccaggtgctcgtctttggtttcggggactccagaacttgctaatggctttgattggggtgcaggtctcgggtggggggtaggaggcaccaggagctcggggggaacggcagcaactgcagagtccacggactcgccctgggcggagagggtccgcacggtcacgcccttggcctccaggctccgcagccgcacaagctccacggccgtgctgtctgccgtggggaagatgacttcagccacctgtggacaagcagagctggctcgcgggctgcccgaggtgagccccgcggtcctgcaatggggagccgaccagtcctctgcccagaggccaggtgcaaaggatcatgcccagcgacctccgactccaaccacccgccaggtatggaagctccaggaagtcttgcggggagggggcggggcaggttcacagacctcaggccccaggacccaatcagtggtagagggttccgtcaggccagtgacgtcaaccatttatctcccatcctctggacccattctgagtagatgcaggggccagagaggggagtgagtgtcaggtttattaccaccacagctggagggaagagaggggctcaggcagaggccaacgtgggcttccgactgctgggagagaacagggctgagggcctcctctgcaggggccagggcccatgctggggacttcccgcctcagagcacaggagtctgcaggaagcggctcaggcagacgcactgcctctgttcccaagtcacccctgctcctgcagggcggagctggggacggtgaggagcagctgctttcccaagccctccctgagggcagatgcttctacttcaccccaggcagggatagggggctggtgtccttggttccccacaccaggcaccagggatatacccatttcttggagtcaaggcctggtcacctgttcacgtgcagacccagcagtatcttaaggcgggacgcgccttcggccatgggtatcatcgtgctaagactcagtttgttgaaattaataaggcagtcatcaatcaagaatgttctgacactaggggtcccctctctggcccctgcatttttaatccagagcagagcagggcaggggatgagtgaggggagcgagatggggggagtgctggaagtgaggaaggggtcctggggttcacgctgatggagtcttcggggttgagggtgcctccagtgatcagggctggaagagcagaccctgcctcctccactgagcaaataccgggccggtccctgctgcgttagggcctaacaaaccctccccacccacccaacgaaaactcaccctctgccctttggcatacacgccgtagccggtaacgtttgcgccattggacagcccggtgggcgtcagcacaggtggtctccaggagacccggatggtggcgggggtcaccccagcctggacggtaacatcttgtgggggtgctgggggtcctgggaggggacagaagggaacggaggcgttcagggaccagccctggcaggtgagccgtgactgggctctgcccatctcacctggaaacgagatcattcggtaaagtcgccagggaaaaagagaagacagtgttgaaagcacatcagaaactgtggtgaggtgggagggtggggccggggtacagtcaggtaccaggatgcacagctgcccttttcctttaaattcggcatttagtcaccatcttctgggaaatgcaaacctaaactgtctgtggaaccacctccttacctgtcctcagtctctgtgacccggcagagctacctctgtccaggggtctcaggcctggccaggcagccacacgattagctcagagaggggccaacgagacgccggcgtttggcagatcgaatggaagagagatcttggcagaaggcaatcccctcatccccccgcccgcccctcatcctctcaccttttcttctctcttttctctccctctaccctctgcccggaccgcatattccccatcttaccaccccatgaaactgagcaaaactgaaagatgaagagaccaggtctgatgacatcgttgaacctgagaatccatttctgcgtgtgtgtgtatatgtgtgtatgtgtgtgtaaatgtgtatgtatgggtgtatgtgtgtaatgtgtgcatatatgtgtatatgtggatgtgtttgtgtgtagatgtatatgtatgtatgtatatgtacatgtgtatgtgtgtatgtacattgtgtgtgtatatgtgggtgtgtgtgtgggtgtgtatagatgtgtgtaagtgtatgtatgtgtgtagatgtgtgggcatgcgtatgtgtgtatgtgggtgtgtgtatgtggatgcatgtgtatgtatatatgtgtatatgggtatatgtgtatgtgggtgtgtgggtgtgggtgtgtgggtgtgtatgtatttgtgtatgtgtgtgtatgtgtgtgtgcgtgtctgtgggtgggtatgtgtgggtgtgtgtgggtctgtaggggtgtcggtgggggtgtccatgggtgtatgtgggtctgtgggggtatgtgtgtgggggtgtgtttttgtgtatgtgggtgtgtgggggtgtctgtgggtgtgtgtgggggggatgtgtttttttgtgtggggggtgtatgtgtttttgtgtacgtgggtctgtgggggtgtcggtgggggtgtttgtgggtgtgtgtatgtgggtctgtgggggtgtctgtgtgtgtgtgtatgtgggtatgtgtatgtgtatctgtctatgtgagtctgtgggggtgtctgtgtgtgtgtgtatgtgtatctgtgagtctgtgggggtgtctgtgggtgtgtgtatgtgggtatgtgtatgtgtatctgtctatgtgagtctgtgggggtgtctgtgggtgtgtgtacatgtattcatgtatgtgggtctgtagggatgtgtgtgtgtggggtgtgtgtgagtataagcacatccgtatctcccaccagctgtgttactctgaagaacaccaaccttgcaccaccatccccgggcatggctaaccctggccgtacctgcaccaccgtccccgggcatggctaaccctggccgtacctgcaccaccgtccccgggcatggctaaccctggccgtacctgcaccaccgtccccgggcatggctaaccctggccgtacctgcaccaccgtccccgggcatggctaaccctggccgtacctgcaccaccatccccgggcatggctaaccctggccatacccaagaccatggggggatgatacatggggtgtggttgaagcatgaattctgagaaatgctgacctacatgtgattgtcccaactacaccttcttcctccaacacagacacgtccctccagtttacttcccactctgagacctcattcccagtcactggggtgagcctggggacccacctctgtgctaagggcccctcctctacctgaatctctccatctcaaagttagtgtccaggggagcctctcctgaaggccccgagagaggtgcccttcacctcctgactccccacggagtgcccgtgtctggtgtttctcgttcttcacccccgcactcatcagaaggcatcgcgggaggcgtcagtgaaaagtgggtggcctcattatcccagcattcttgatcaactccgggcagttggggaggaaataaaatgtcgtcgtgtaacagatgaactgaccctgcctacgttagctgctacctggacgtgctgtccccctcaggcagcgtctgtcccacctacccctgacaccactgctctgtcaggctctagctgaccaaaggtttcatgaatatcagagcgggcagtggaggcttccggaggtgggggtgctggctgcccagtaactcagcagcactgggaccctggcgagtcggagagcaagaagacgaagaaagtgtccacactcaccccacctccctaccatctccccaggaaaggaagggggcacatcacactccctgtttgagcggagatagcagaaaagaacactggagttcacatcgcggcgaaaatagcttctgtgatgaaactgcatctcttttatacaagccacgtatgcatgcttagaggcttgtgcctgtaattccgacactttgagaggctgaggcaggcagatcacgaggtcaagagtttgagacgagcctgaccaacatggtgaaaccctgtctctactaaaaatacaaaaattagccgagcgtggcggcaggtgcctataatcccagctactcaggaggctgaggcaggagaatcgcttgaaattgggaggcagaggttgcagtgagctgagattgcaccactgcactccaaactgggtgacagagcgagactccatctcaaataataataataataataataataataataataataataataataatttacaaggacgagaaagaaggaatgattctgaaaggcacgtaagcacttccaggcagtatccaactcagtgagtatgtgtccaggggtgcatgtgacacggaagatgtaaccgtgtcccctggggggactcacttccctcctgtcttttgtaggatgagcctcttgttgatataaatgctcaaagaaaaattgccaacatggtccctaacatgttccaaggactcttgtgcacacgcacacacgttctgtgcttcgccggtgacctaagggattttccagggtcatgttgtcaggatggggattcctgcttctgcctgccccaccttccctccccactagcagggtgacatcctggcgttctctccctgggggacccacggaaggacacagggctcacctgcaggcaacgtggagaactccacaaaggcctccttcttctccctttgctccagcgggagctgccacggcatctggtggggtttggccagaaccttcaccttataggccatgttgggcctgagattgaagaactggtacttgtacctggcggccttgacgatgtcgaactcctcctcgttgaggaagatgacgtggctgtagttgctgttggtgggtagccaggagagctgggcggagatctgcgtgatgttgtccacccgcaggtgggagggggccaccaccacgtccttgcccaccagcagcgtgcactgcagctcatccgagctgcccctgctggtgacgcactgcacggagatgcggtaggtgcaggctgccatgttgagcttctcgatgagggctttagttctgctccccagcgtgaggttcatgcgtgtctccttgtccaccaggacgttgtagctgctcaccgttccccatcctggtggcaccgccgggggctcccagcccacaataacacttttggcgagttgtttgatgagggtgatttttctagggtaaggcacgatgtcttctccgatgtcgtcgatgttcacgtccagggtcccggcactgttgtcggtgatgcccgcatctatgtgggttggggagtggaggtccaggatgtgctctccctccaggccgatgccggaatggttgatgaagttctgatcctgctcgttccccagcgtgcttgccaaccgcgactcgttgtcctgcacaaagtccacgaagttggagggcaccagacccctctggccatcgaggagctctcctgttgggtacaaggacagagttatcacccagccaacacagcaggggcctcgaggcccccagtgtactcccacctcccccaccaggaccataaggcagagcaacagggttgccctggggctcctccgctgttcccaggagtccatgctggggccagctccacacccaccatctaaagagccagctcctccatccccgtggcccagtcttcttttctccatgatacttatcgcaacctgaaaccatcatgtttgtgtatccgtgtacgtacactgactaccccctcccaacacgaacaacactcagggacagcagggaccacacgactattgaatgcccagccctagagtgacagctggcccacaacagtgcacaggaaagatttgttagaaggacgagtcagtcaaatcagtggcttttggagattaagaaaataaacatcttactatgatttttgattaagaattaaaaggtgatttcctggcccccttgaaaagcactgggcacatcttaatgaatgcacaatgtgtccaatttgatgtgaaacaaaactatcaatttggtgtcagaaccacaagttgtgtggcaaaaaaaaaaaaaaaagtcaaagtagctcttgtggttaagagtggacatagtggggaccgctgtattttgtgaaagtctaacttctacgtgctttcttcattagtagggctcacaaggctgctaacagcagacggccagaaaacggagaagtgttcagagcttcaaagatgaggcagtttgggtaatcttccagcacagacccagaatggaccgtttccaccaattcatcacaaggtacccacagacccacagagaggggctgggaaatgctgagcattggattctgcgcccagaagaccccctgcctcaggggagcatgtgatgtgttgtggcccaggggaagacatgtcaaccatttagttagtcctggatgctaataaaataaataagaaggacttggattccgttccaaacctccacctagggtgtgggtctgcaggagccaatcctttgcactgaggatatgctatttaaaaatccttagtttggcataggaggagatggaggtgatggtgatgatggtgacggtgatgatgatgatggtggtgatggttatgaagatgattataatgctggtggtgatggtgatagctactatttattgaacaattactatgtgctaagctctatccgaagaccgtcgtatctattatctcatttctcctcagaccctctatgaggtgggtactattactatctccattctatagcagaggaagctgaggcacagcgaggtgaaggaagtttcctgctgtcacacagacaatggagccctgagttttgatccctgcctgcaaagaggctcctggaatgcttctgtgggctccatgtgtggtgagaaagttccagagatttcaacacaggttttctggcagctgccttgggcacatatttctgtgcttatgtgaaaatcagtggtgataatgtggacttatgggaagaattcaaactgctttgctaccaactgtggtgagagttcttggctggaccatccagagccaagaacagctggtgagagagtggtgagcgagtggtgagtgaggcagctcgactgctgggctcctgctcatggacacctctagaagtgacccgacctcaccccaagtaaacacccaggaaaagcacctggggcttccatcagctccgagaaaacagcatgaggtcacgaaagagaaacctgctagcttagcaagcaagattccttctgctcagggggaagaggaagaaaccaagaccacgctatttgtccagggcagttgaaacatgtagggaattagggaatcaaatcctttagaacgttgatttatgggctgctggtgctgttacatgtttattctcaagctaaaaaggcaacaaaaggtggggcctttcagatgatttcaaatttggagaggagacctcgagggaatgagcaggggcaacctggggccaccccctaagttgacaacagtgccttgaagtcaaggagatggatggccttccacaggtgccaagagccaccttcccgtgaggtcacctggagcagaacaaggctctgccagagagggtgcctctgggagaccctgagggtgctgaaagacaagagcaggagagacacttttggaagcagagggtctgtcagtcccatgtgtctgcaaatagctgccaaaagctctgcagaggttagcggaaaacatctaccatgtgtcagaggtcagcttagagctgaatactggaaaccccactcaggtttctttccagtcgtcaaagagggcaaacctggtaactacggagtggggaagggtcagagaggagggctgggtggccaggagtatgttgggagccctgcctatctatcaggcccctggaagaggtggtctgcggggtggactggcccagcctacgtccgccacagccatgttccaacagagaccttcatagaacccatcctcatccatgtctccatagacgtagaggtattttcccgccgtgaggggcagctcagcttcggggttctcgttcggtccatcgaaggggttgtaactgcagagaaaacacagttccttcattagaggctctggaggacacagcccgcacccctgtccgtgcagaacgccagacgggcacatggcttctctcccactcctagggaattacaaacccacataatcgttcggggctgatgagttctctgtacactggaaattcaagccactgccagctcacacacacagatttaaagtaaaaatgcaattcggaaatgaagttatatgctcagaactatttgcatcagataacaggtttatgattctgacattctattcacacttatctcttctgctgtaactatacatctccaaattagcaagcagatgtgaagaaaattaaccctataatctttcaataatacaatttagtgaaaacagaatcatatatactatttagcaacctgcttattcttccaccttgcaagatagcatcctatacttctacctcttgaaatattatcatcatagtctttttaatgggtgtagagtattccactgaacatattaacatactttatttaaccagtttcctaatgttgggcagtgaggtttcttctaacttttggctaatataattagtattgcattatatattcttataaacatatttttgcacacttccacaatttcttcctaatgataaatcctaggaaatatacttatttggtcaaaggcacctacatttttaaggtcttgggtgtggacagtcaaaatgctcagaaaaacagacgcatgattttatgctccccccccccacacccccaggaatataagagtatccatattctccagtcctcaacatattgggattaataattttcaaagccgtgtccaacttggaaaatcaaacacatgaaacaaacccagatgaattggggattctctaaataaaaggcaaattaacttaaaataacagcgaagaactcattaaaaaatgaaaataacattagagttggagaagatagccagacactgtaatattataattatgatatgaaaatgattcatgcatcagtggcactgtgcagtttaccaacactttcatacacgttttattcgatggccattaaatgttaggaaaacagagaagataaggtccccagtctcaatggctgagtgaggtcaggcaacatgcccaaagtcacaagcttatgaatcggtggaaggggaaccagagctgagacctcctgacccgtcctgcgcagttttaaccacaccaggtcacgtggcccctcatggtcagggtgcagaggtccaggaacccaatccaagaccctgacagcacccagcaggtcagcctagagggctgtgcaccaggaactgacatgggccaccctctaacacaaagctcggcagtggaacgggacaagagctctggaagaaggaatagcatgcgccaaggcccagaggcagggaggagagagatgaggttggcagggaccagactggttttaacctgatctcacaagctgtgggatgtcatgaaagagttttaagccagggagcgacaggatcatgtttgcgttttacaaagagacctcgtgggtgctgtgtggatggagcttggtggaggagttccagcaaaggagtttggtcggggagtgacttaggaggctgtggaaatgcgggttgcctggctgcagggatgagggactgaggtgcaggaggaccctcggctttctggcctcagggtgagcaggcggggacacaagtcactgagtgggggttttcagggggatctgcaggggggtctggatgggtagatggccgagacacagaagctggcagagtgttctcggaggaggaggaggaggaggagggagcgagaggaacaggagcccccaggccacgccttcaggagtgcccacacctgacgctcaggaagagaagcttccccagggagcaggtagggaagacacaccctgagagcttgagagggaagccgcggaggccaagagggaaggtgaacaccgagaagggtggaagaaggtccctggctggtaagggcacggagaagaagtgggagatcctacggctgtcgtgacaacctcgtcggtgctcctgcgtgtgggccctggaggccacccgacctcgtgggtgttcagggcagacgctgccacgtactgtgtggatgagaccaggggacacgtcgggaatggggactcaacagagacagaagtaggtcaggggtcacgcagcgctggaggcgggggaggagggacaggtgatcactgatgggaatgggttcttgaggggcgatgggagacgagggacaggtgatcactgatgggaatgggttcttgaggggcgatgggagacccccacatgtggccgtggcatctgtgagcacagcagtggccctgggcggcacactgcaagtgggtgaactgtgcagtgaggaccatctctccgtacagctggcgaaaggaaggatggtgatgaatgtgtcagcctcaccctggacctcgggtgggaaggacccaggagccctcagcaaggcgttccccacggcggaggctgcaccagatggaagggaggagacatggacacagaggcagcccctgcatggagggcggggagaggccgctcggcacccagagtgagcgcccaggtgagcaagaggctttcggtttgcagaaatgtctaagcaggttgctgaataatgacagcaagaggagacactgattagacccggggcagaaaacataaccccctccctacatctacctgcaaagccacctcttaggggctctgagggctttcagaaaactcagaaacagctctctcggggaccagcactatatgcccctcacaatttgacttggtttgagagagggtgggtggttaaaaaaaaaaaaaaggcataaatccatcaccagtaaaataggaataccactgaaagagtgagataaggagaatgtgcgtgggctgtgactggtgatggccacgggagaggcagatgtgctggctcgtcacgcccccgcttctggagccacaccagccgtgggtcagtcctcgggggacattagctctagggcagctccccccagaaaagccatgccctctccatagaagtggcaggaacgcaaacccagtggccctctgaggttggccatcgtaggtcgcatgtggcagcctcgctggaccaggctcatgattgggaaggaaggcgtctgtggcacaccaggcccctgcttggctgggaagccacctcagcatgtgccaggctcagaggacaccagcccagcgctgcccctgtgctggcattgagggttctgtgaatggctgcgcctgggcctgctccacacacagcaagaaccggactgaaggagccaggggtaggactgggtcttcatcctggccccgccaactgtggccctgtgcgtctgcatgcaatagcctctcagcgctgtgatgctgtcctccagcatggtgacagatgagcggatggtgggcctgcccccacctgggtgcagccagcattcacatctgcctgggctggattctaatgggagcccacagcccaggggcatctaccccagtgcttctgctacctgaacctcagaaatgggtttgctttggtggaactggtgtattaccaacgagcggaatgtgatccgctgatcctcttaatggtgttagaaacagctcttgctggagaaagcaaaaggtattcaaggtgtatggactggcttaaatcaagagtcacctcctttgcatgaacagagtttaaggatctagtgagggtggcaactgcactgaagcttggtccctaaacagatcacgggactctggctgcccgatgccagctgaagggcagggatatctgcctttgaaatactgtcaggtcagcctcaggccaagcccacgctcagagctgttggagcatctgtgagacaaaaggctgggtcttcacgagtgctaagaaatgggggtgaactgctctgtcttgggcctgctgcccctggctgatgaattcccaagtgtccgcccatgggcagagttggctgcagcttgctttccttacgatcaggtagtgcagtcctgggggacctctcatccttgcccacgtccgcctctgcggaagctcccgtggaggacctgagaggtgtgcgggacaaaactggctcattacctctcagcgagcacaaacactgaaggcccctgcacgggaagcccactcagcggctgtcatcgcagcgagatgcagcctgcagcgcccagcagagggtgaggatgcgggagatcagggtgctggacacaccccctttcactctcggtggtggggatcggggctctggacatgtcccctttcactctcggtggcgggatgtcccctggaaagacgcactcatggaccaacccctgcacctgtgaatgggaccttatttggaaacagtctttgcaaatgtgatggagttagtcatactgcagcggggcagattccaatccagggaagggtatccttaaaggaagaggggagaacgcacaaagacagggagggcgaggcggccaggcaggatggaggatggaggcagagactggagccacgcagctacaagccagggccgcctggtctcccggcagccagaagaggaaagaaggacccctccttggagccctcggagggcgagaccctgccgatacccccatctcaaacttctgcctccagggttgggagaggagaaacctgtagtttcaggccaccaggtttgtgacctcctgtcatggcagccctgggagacttgcgtgccacccaaactctctccaccgaaccctgctcagcctccaggccaggctgaaatcccaccttctcctcgtgccctgggagaagggaacttctcagaccccagagtgttcccagacccaacatctcatctgccccactcacaggggctcggtggacgccgaggggccgcacttacctatagcgggcaacacagaggtggaccttccccgagtatctctgcttggaggtattggaattccgttcattctccatctgtgaaaaaggcaatgggtgtgtgggttattgaagctggaggtgtcccaccccattcccgcggcacacgggaaagcccctcgcagcttcctgggccccaggagggacggcctgagactgtggcactcccaggaggcactgccacccgcacacccacatgcgagcttggaaaggagggtggtccctcggtgtggaccccttattacataggccccctctgtgtttgtagagaacccagtccccaaacaggaaggtaaggctcaaagactccgcccagtgtctcctacagcaatcccgggagtcagcggcgtggccttttctcataggggtgggggtaaaattaagcagtatgtgcacgaccccccagtgatcccactctcactccccctagtgcattccccacacaagctggaacagtctttaagcaggaattagaccacatcaccccctgccttaacagctttcagtggcttcacctcggactcagacaaaaagccaaacgctgtcctctgcccccgccccctctccagccacaccagccccttcccatcaatgccacaggacaggacgcgcagggccctccccaacctccacaggcccctcccggccagctctgcgtcaacagccttgctgcgtcatccttgcacccctcgatgggatttgcttttctaaacgctgcctcgccagtgttctctctgctcccccttagaacagggacctcacctgtgttcacagaggggcccccccacattccagcacatagtagggcaagggaattaacaggggcaaagggaagaaccaaccagaaggaagacagggaggaagatggggaagaaaaaacaggacaaactggccaacgtccacaccagacacacacagcacaggcagccccggcagcccctgcgggacgggactcacgtctgactcagatctgcatcttgcgctaccggatctcgacaggaaggtgggcttggcggacagaggctccggcctgtcaccaggctgcggaaggggccggatatattcaccgatcgcagagctgcctccaatagcgctctcctgacctggccacgaacattaaaacaagttgaaacaaatatgcgaataacatcgtcaaagcacgttggtcatgcgcctacccggggtgcctttcccctctttgacaacagccactgattttcattttggggtccacccgtctcctgctcgccatctatgtaggctggcggcgcgaccccaccctcagctctgggcccgtccagctggcagagccaccctggcggtaacgctgtttgggggctcaggacgaggatggtcccaggcagagggaactaaaggagagttgatggcaaacaggctgctcctttccttggcttaaaattgagcagctgtgaagctcagggaggccgcaaacctcctgcacctgcgagaggaacgctcacgtgaggacggcgcctgctcacagcgagaccgagagaaagtggatcccggcgatgggcttggagcccctggttcaagatgtccctgaagccacgtcctggctcttcatctactcaggtgacagacagactcctttttgctcacaccagtttaggttggctttgctgtcacttatgaccctgagtcctaactggccaaaggggtgggtttgtggctaaaaaaatactcttgacgagagatttgcaagggctgaaatagttcttatcccgtcctatcctcctggggtctcaggggctgctgagccctgtcctggttgcctggaagggagcattgagcaacgtgactaacgctggcctgggtgtcagacgacagcgcagcactttaaccaggatccgggtgtgaaacatgacgcggctgcttccttcccaagctctccgctgctgggaatgatgacaccccctccctggggtcctcggtccctctgtagctgtcacatcatgacagtcacctcactgatgaatatgaattgctgagtccaaatcagtaagtataaaatgatttaaaaaaccatgaggaatgttccacaacggctgccctaggagccgcccctagcaggccccacaactccaggctggagtgaacagcaggacagcgccaccatggcagggaattggagctggggcagccctgccctggggtcccctgtgagaacatctgatcctggagggcaggaccttgttgtattcactataacatggctcggcgtgtagcaggtgcaaagtgaatatcgaacgattcagcttccagaagcctcggaaacccagccgacagcagagcctgctgcaggctactccccttccaactggcattgctgcctcttctctgctcccagccacgagagtcacctgggccagtgaaccttgaggggagtggcaggctccacttgtgggcaaaagccacttttcctccccacacagtggccagggaactttccagagaggaaacactgtcctccagcgttccgagacctggggggccgcgtgtgactgcagcagaacttggcccttcctgcctgacaccgcgccacagtgaacagcaggggacggcacagctgatgaaggtgatatgaatacagtagtcaccttgtattcacaatttatccaaacccaactctctagggaaaaataacgtaatccccgtggcagcttttacctgccattgtgcctgagaagacaaggtgagattagaaacaaaacgtgcagtgccttcaaatggggctggttcccacgggcccctcgagatgcaaacaccgcgctctctcatgatggtaatgcttcaaaatacgtatgttctagaaaaatataggtcaaaaaaatgttgactcaaaaaacccagctcccatactggaaggaaaactggctgcgccagggataggagaggccacgcctctccccaacacactccttcctaggaggttgccggggacagtgtggcccatgagcaacgcctgccctcacatactgactgcagcgcctcactctgtgtcagaggtgcctccccatacagggcgcgagtccctttgtggcctgccccagccacaggctggaggagccctgggtgaaagtgcaggtgagtgacagcacatccacccgggaccccttctctgtcttgcggccagccctgcaccttccaccatcctctctctcaggtcagtgtgggaagatctgcggcagatgaacaggtaaaaaatacagatttgaacacaatgggatgttatccggcctcaggaaaggaggacacctggccctttgtgacaacacgatgcacctggaggactctctgctacgtggagtaacccaggcacagagatacaaacatggcacggacggcccccactcacgtgggaaacctcaacaaggccaactcgcagaagcagagaacagaacagtggtttccaggggccgggccgggggctgttgatcgaagggcacaagatgaatactctttggggatctcctacacataaacgtgaatgcagctgaaatgctgggttgtaggccaaggcggtggctcacacctgtaatcccagcactttgggagaccgaggcaggtagatcacctgagttcaggagtttaagaccagcctgaacaacatggtgaaaccccatctctactaaaaatacaaaaattagccaggcgcggcggtgcacacctgtaatcccagctacctgggaggctgaggcaggagaatcgcttgaacctgggaggcggggcttgtactgagccgagatcacaccattgcactccagcctgggcgacagagcgagactccaatgcaaaaaacaaaacacaaaaaacaaaatgctggattatagacttgaagtttacaaaggaggcagatcttaagggttttcaccatgaaaagaaaaggtaaccacgtgaggatgtggataggaggtggtatgttaattagcttggctgtggtgattatttcacaattgatttatgttacatcggatcaagttgtataccttaaatatgtatgatttctaattatccactatacctcaaagttggaaaaaatgtacaaaaataagtaaacacattcagagagtgggggaagaaagaataaaacaagaggagaccctaagcagaggcctggaagaggggcctgcgctgtctgcagggaggagtgtcctggtgggatcggggtgctgtggggcagctctctggaggcactggtgtccaccgccgtcataagcgacatgcactgtgaggggagtgccagggcaatgccaggggatatgggcatgggccatgccaggcgacccctggtgggtgaggaaactgtgattaaatgaactggattcattaggagggtgcgtcttccagacagttgttaaacagaagccgtggtgcaaaccttcttctctgccaggcggccctggcttagtaaaggcatggtaccactttgtttttttggttttatgcagtgtgcattttccacagtggttaatcagattcctttttccatgctggccaatccctgttcccgcctccctgtcccgggagctttgcagcgggttccacattcacatgctgtgggcctcggactcaccgggcaggcctgggactgctgtttacagaagggccagcttgcaaggtgggtcactggctagtgtctggaactcagcttctgaaatgtcccctacactggatggaaacatcccctgactgataaaggcaggcctagcttgtgcacaccacacagctcacactgaacacctgctttccttccaggagtctggagcttcggtgggcacggtgcccgcgcaagcagcccccaggaaaagctctggacccaagtctcagtgggtttcccagagcagaagccgtgcgtttcttgtcgcacggagtggggctctgtgtggcccttcacgggagggagagagacagcatggagacacgtgcattctgttttcccctgggaagaacggaaaccgtcttgttttcctccactcttcaggtgtcacagctcaaatgtggtttcttggcagccgccttccaggaccatctagaagagcccaagtcactgtccacctcatcacctggtcttcatgcagcgtctggatcagaggctccccacgtatcgtctgcccgccagcgggagctccgcacggtgccctgtctgtctctcagcgttgcaacctaggcagggcatgcagcctgggtgtcgtgagtgcctggagatgagcggcagagcgctcggaccctggtccctgcctgctggcctcccacagccacgaccacttaccccacccggcattctctctgatgcgtggaccaaaagggaagggcatgggaaggcgtgggacgagcggagaggcaggagaatgttttttagcaagacacaagtggcatctccttattttaatgataaaaagcacccaaggtacttatatattctgataagaactaggggaaatttgcaaattatcttttttacagaattccaaagtgaggttcagacgctcatctcccctaatttttttttaaaccaacttcttaaacaggtgggcagacctggccatgaaacctgtctaacctctgcatcccacttaaccttcagccaggacgtagcacctccaccgaggtctgattaaaggacatctgtgatcgctctgcctgcgaccaagactaaatcccccagcacacacacagggggcttctccccacccggcctctaagcaggactgtgatgggcgagggctcatgttcaccactgcctttgctagaacagaggttccaagcacgtcccaacatcaccaacaagttactgagatgagaaggaaggaaaaacaacgaacacagagaaatgagcttcacagagctttggagtacccagccaagaaatccttgtggagtcgttgccagtgcagactctgcagccagactcctgggttcaaatcccagactgagcctccatcagcatctgtgtgacccacactagtgctttggtttttctcgcctgtaaaatgggcccattttacaggtgagaaaatgtgtgggtcccacatttgtggatgcccgtgaggtgctgagtgtaccgtgtgccccacggctgtgagcagccctgttctcatccttcccattgcagtggcgggtccctgtaccctctgccaggtgtcaccaaaccgatttcacctgtgcacaccctcgcaggcagccaacggccattctctccccaccacagccaaggcggaaggtccaggcgcttacctttgccgagggaggtggctaggccattcatgaactgtgggaaaggcttgctgggggccgtggagatgtccaggggggccaccgcgctgccacccagcaggtcaatcttgccagcgtgctgccggaacttctccaggtcccgggacagcaggttgaactgctcactttgagtccggcatttctcttccagctctcgaaccttggactgcacggcagaagcaggacagggggtcagcggtggcatttggtggtggaaatgtgtgtgcgcctgttcacatgtgttgtacgtgtgcacatgtgcactgtgtgcacgtgtgtacacacgtgttgtgtctgtgaaaatgcatgtgtggttgagtgtgtgcatatgagcatgtatcctgtgtgcacgtgtctgtgtgtgacatgtgcagcaggggccgcctcccactttcacgggagagcagtgcctgataaacccagcttctcctgccacctggctactggccaatgtgagaaaccacaggtgccaagaaatcctgcaaacactcagctcccagccaaccgtagattgttctgggctgtgcgtgcagcccgggcactttgcagttggcaggctttgctagagctgtttggaacttggagtatgaggctgtgatgcggcccagactcaggggagcagctcaggtgctgtcccatggatgcaaggatgcaattcttctcatccagggcgcccgccccctcggactgtagaacccttaagagcaccacttggagcaataaggactctctatctgctatgttcagttagcaacactgctgcatttgcagacaacacgaagccacgtcgggagccctggggaaggcaagcgtctcccccagggacacgcacaggaaaggggtagcccagcaaactccttcctcgggtcaggacaggcctgggctgtgtccagtctcgggacatctctgacccttgtgggcttcctcccaggtcagaggtgcatgggcaaagccccgctccctgctcccctgggacttgagctctacataagacatggcctcctgacataggtttctggcacccatcacagaaggtgcaggacagaggggtctacagaggacccactctaccttctcaccccgcgttcctttctccactgtgctgaccgccccccggcactgcagtagctcctgggctattcgtttcttgtcggtgtccacggctacactctcggccccaagcctctgctttctggctcaaggacacaccttcgatactctgcatggactcagcacccagcaggtgctcaaagagcgtttgctgaatcagtgaaaaaggcgagccctgagctgtgggcaccgtgctcctcgtggggatggcttgtcaggtctgcatgcaaagccgctttcttgccactccttactttaggatggccgggaacatcccatttatggggttattcatgtcatctgtggggctgacgacactgacgtttcccccagtgaaatgtcagccccatgagggcagggctttgtctgcctgtttcctgctgcgtcccggacctgagcaaagggctcagcaacagccccccacctccccctcccctcctccgcccctcctcttcatccatcctctcccccactatccctccacaggcagcaggcttctcagctccttagtccagaatgaagcactatttatggctgagatcatggatttctaaaataaacctaacaaatccaaagcctataattaatttctttgattcattaaaagaaatcagcagtattcttctttaaaaagctgaatgggcttggccaagccggctgtgtctaccaagataggcatagagctaaaaacccaggggctctggggcctgacatggaaagcatcggagggaacccaagcccagggacagctccgaccccaaatgtggggtctgcaggtgggatgacgacttggcttcgcagggcttgcaggggctctgactctgctggttcagcccttaagacagagtgacgggccctgcagggcagccagggtcctggccagggaacagctgccactgcccgctgcaggcaaggccggaccccggaaggccctgagctcaactgtgtgagccaacgaacccccaggcacccatggggcactcgcggagccttcccagggtgtggagaaacaggagacatttaatagtcatgcattcattctaacatgtgacagggaacatgtaactggcacacccattccctaatgtcgtgtctatgaaaatgacctaactaaaataggccaggcacggtggctcacgcctgcaatcccagcactttgagaggccgaggtgggcggatcacctgagctcaggagttcgagaccagcctggccaacatggtgaaactcagtctctactaaaaatacaaaattagccgggcagggagacacgcgcctgtagtcccagctatttgggaggctgaggcaggagaatcacttgaacccgggaggcagaggttgtagtgagctgagatcgagcctctgcactccagcctgggcaacaagagtgacactctgtctcaaaaaaaaaaaaaaacaaaaaaaaagtgaatagacttttcatacaaaaatcttgaaatgataaaattatagcaataaagaacagatcagcggttgtcagggttttgggttaggggagggtgtgacgagggacggtgccatgagggagtttctctgggtgacagagccgtctgtacagctgatggtggtggtggtggtggttacgagaatctgtatataccaccaaatgccatacagctatatacgaaaaaaaaaaaagagtggatataaacactcgagaaagcaagtaaattccccagcatgctacagtgctgctcccacgccagcttcccggctttgagaacacactctggctacagagacaccaccaccgggaagcaggaagaggggccacgggaactccccctgctgtctttgtaaattcccgtgaccctaaaattacttcaaaataaagttttcagaaatgaagagattttaaacaataggaactaagaatacaggtggcatacagagatggtgaagataatgaaaggtaccaccccatcaagggggctaagggcggctgaggtcacaggagcctaaagcgggttctgcatctgatacacacctgccagcagcctgcaggctgcgggctgcctgcttttgtttgcaggaggacaggtcgtcgcaatacagagggaacagggcaggctgtctgctctcacatggttccatgggactcccagaaatgacggggggtggggggccaaggacgagggtgagccgagcagcagctgcatactctctgtggtttggtccccagggcctggcagggccactcccacgcctgtgtcctatgggggccatagtggcgcttcccaaggtcagccccttgccctggcccatcagtccatcctcaaccgttagttcacgacttggcacagggtggacatttaacagatatttgatggatcacaataagctgcgggtaaactaatctacgcacaggaactgtggagtacccttcagttagagatgaaccaggtcacctctgtccaagggagacagaaaacgggtggagaagcagccaccaggtggctcaccaaggaaccctgagacccctgcacaggggccgctgtgtcatcacaggcctgggtgttcatcagggccgggttccctctcccacggggaaccctcagctctaggtatcctgtgagtctgtgctccaggccccactctgtgcacagaggacgcaggcccctcggtaggctggaagtgccgtcagcagcagcaaagcggcgctcgcaggagcagccgtaatcatggtggcagtattggtattgatgagcagtactagtatcagtagtactggtattttcatcacctgcagtagtagaagtcttgctttggtattagagcattaacagcagtggtagcaatagcagtgttttttgtaggaatagcattggtatgagtagtggtatagtaacagtgctgttggtattagtattaatagcagcctagtattagcagcagcagcagcagcaatattggtattatttgtactagtagcaacagtatcattattactacctgcaagcgtactggcgttatccttcacagtcacagtttggtgttagtattagtagcagcagcagatgcaatattagcagcagcaacagcagggatattggtgttcttagagtggcagccagccactgtccttgcttcccccgcagattccccagggcctggcgccggggacatccaccgcgttctgagggggtgtcgggagcaggaggcccacgggcagcagtgacgggggagagccagctcgccttgagccccgtcccacagtcccctcacccaactgggctcactgcacaggagattccatgccctcctgtgacacaaagtcactcccttcttgaagcctgagaaacgcccccaggctcccagctgtcacctcctcccggagggtgtttctcctccaaggggccaccagatagggccagtggttcgccatccacaagggacccatccgcacgacccagctacttcctgccaggctccacccgtgacactaggggtcacatttccacatgagatgtggatgggaggatgccctagccacactgccctgcttctctcgaggcggctgcagagagcctggcccaggggttgtagggacgctggctctgcccagcccattcttgccaactgctccttacacctcggggggtcccggagtggacttgagtgctacagcaaatcaccgtgtggacacagtcctgcacgcagactggcaggggtgccagcaggggcaggggcagggtagacctgcaggaactcaggatggggtggtgagcagggcaaccagctctgtccaaaggggccggtgcctcggcccgggtgcagcccaccaaagacaaagctaaagcttctggtttcccaggagcagcagggcattgtcccctccacatctcatgttgaaaagctaaagcttctggtttcccaggagcagcagggcgtcgtcccctccacatctcatgttgaaatgtgacctccagtgttggaggcggggcctggcgggaggtgtctgggtcctgggggtggatccctcatgaatagcttggcgctgtccttgccataatgagcaggctaagttcacacaaggtctgcttgttgaaaagagcctggcacctcccataccctcctgctctcagcacacgacacgcctgatccccctttgccttctgccatgattgtaagtttcccaaggcctccccagaagccagcacaccccctgtacagcctacaggaccatcagccagtgactccttcataaatcaccttcataaaccttcataaatggcccagcctcaggcattcctttatagcaagaacggcctgacacacccagggaattttcaattcaccggaagtctcacattttaaaccctgctgagtatttcaaggcccatcagcagcctgggctgacaggcatgtctagagatggctgcaggctgtggctgctggccgtggtgctgctctgcacgacagcatggtgacactcccgcatcagcaggttgggtgtgtggggggtcaggttggatcaaatgccctcatggccctgtagatgcccccggctgtacccacataagcctccgacacacaggacgatccctcacttgctcctgggcctggggggttctggaacttagaatttgtgaccctctgcatgcctacatccacctgggcattgaacacgcacttacagacaagctgggcgatgcattgccataattgaggatcccacccaggggtggccagtgcagataccaggaaggccgcgctgccgcaagcctggagacagctgccccgaggatgcctgcccggctgcgtctccaccgaggcccaaggcacgctactcggcgtgaccataagcataagggatgggagaaacgggcattcgttggttaaagtgaagatatgtcacccagctcacacatcttagcactgcctcacctttgaacgagcagggtgtggactagtgaggccctgctcctgcggtctcaggcacagtgctcagagctgggtctctagctggtcctgtgtgtggacgctgactcgaggaatctggttgccctagtccctgtgcagttgacgtgctttccccgaatgagcatcatggggccaaagcgcaagcaccctcctagcagggcagagcgctggcaccacgtggagctcacagaccaggcatggaatgtaccctctcctgcctgcttgtccaccagcacgtgctccgtaaatgcttgtctgatgggagaatctgctgtgagacttgctttccttgtaacctacaatgaaggtgtggaacaggggcacagcctcccccacctcaaattcctaccaaggagaacctaagagtcctgcccgcccacatccagcttgtttgcacctttcctttaggctcctcgcctgagcacagctccctggcgtcttggcagcagggaaggctctcgtgactgccaggggggtccctgctggggctaagagcttccaattgcctatggggaggaattgccagcagcagccgcttccaaagcatgctgagagaaaagagcaacccgtggtcctgccccaggcaggcgcatttacacctcgatatttatttccggatacagagtgctgtcctgtctgggtttgggactgggcctgggtgtcaccccggctgcagggatgcagggacacacccagccccatggtgctgctcctccccatcccgaggccacctgctcggcgctagggtctgcagggcactgctcagaagcaactgagtccggaccaggcaggaacagatggcagagtcatcaggcaagtcaactgtaattggaacaaacagcagaggctcgcaaatgtggatgtggctatttctaaagacaagggggaagcatccaaagacacccccacagctcccccagctcctggctcagtgccctcctctggcttcccggcctctgtgaagaggggtgataagcaggcgctgtgctggcggctggcatccaaacggggtggttctgagagcaaggggccagatgcataatcactccagaatcataggcagaacccagggacggtccaggctcaccgggtcacttgacttagtgtcagaggcgttcaaaccacagcgactccatcttgaataggggctgggaaagatgaggctgagacctactgggctgcgttcccagatggtgaaggcattctaagtcacaggatgagataggagctcagcacaagatacaggtctcaaagaccctgctgataaaacagggcgcagtaaaggagccaccgagacccaccaaaaccaagatggcaaagagagtgaccgctggttgtcctcacagcacattacacgctcattataatgcattggctgctaaaagacactcccctcagcgccatgacagtttacagacgccaaggcagcatcaggaagttcccctacatggcttgaaaagggtggagccctcagttccgggaactgcccaccctcccccgacaaaaactcatgaacaatctaccccttttcagcatataatcaagaaacaaccacgaatagcccacactgctgctctgcctatggagtggccatccattcgtttcttcacttctctcacatactggctttcgccttcctctacggactcacccaaattctttcttgcgcaagatccaagaaccctctcttggggtctggatcgaggctgctttccggtaacattaggaaaatttggaaacaaattgtcccatgtgctgtctttatgtgatttcattgatcactggctgaatacctactatgtgccaggccctacgtgatttcattgatcactggctgaatacctgctatgtgccaggccctctgatttcatagctcactggctgaatacctactatgtgccaggccctacgtgatttcattgatcactggctgaatacctactatgtggcaggccctgcgtgatttcattgctcactggctgaatacctactatgtgcttggccctgcctgggggagtcatgcattgctgctgactcagagagacctccccggtaagttggtgttaggccattgcaccagggcagaagacgaggccaagagggacttgcggtcacacccccagtgggcagtaggacccacccaggtctctctggcctctgagtctctctgtccagggcccacctaagcccaagcctgtgccctcactcacccacacattcccctaacacactcactggcccaggggtcacccagcctctgaacaagagccaggcagggctggttccctgcaggccgagcaggcccagcgcctgggaccacagccctttagcttcaggggcccacagacatggttccattttagtttcttttaaaatcagaaaagaagtgaaaaagggtgagacatacatcatgcatccagcctgtgtaatactcatctttattccacaatagacgcaaaacacaactgttaggattattttatggaggaagggacgacccctaaaggcaaaggccacacagcccacaatcatccactgcaggcctgaggccagacgcctgcggggaggtagacctcagcctgcctgggaagcaagcacgctggccaccccgaaagtctcccagggaggaaggggggctgttcaggaaaaatagccgggctcctctgaggccgagacgaaccagggctgacatcacctgaggttcaatgcctcgctccaggaggagacacccaaggcgctgtggagagaaggcgagggactcccatcagggtgccctgaagaaccaccacagagctgccgacacgcacacgccaagcacacagcactggcacaggctcctcatgacgttcccctgaccaggaagcccagatcctcatctcttagcccagccacatggtgacaagcacaccagcccctagacttttctcaaagcacctgagagggtgttaccaggctgacttcctgcccttggggccatgccctggcacttgggagctgtgtgtcctcgggtaagtggctcattgtctctgtgccccgattgcctaatcagcaaaatgaggtgacagagaacctcaggcagtggtttcaggggttaaatatgactgtatttctcaagagcctggggtaaagcgacttcctgcattcctgccctctgctactgctgcgcacccagggaataccagcgggtgaagatggcccggccggcgcttcctcagtctggagctgccaacactgacttatgattcagcctccagtacgctctacaggcaggaccagggtcgctgtcccctctgcccccacccagcacctgcagggaggtcagagttctgagctgacaggaagctgtgctgtgcagcagccgtggaaggcctggactccggagccaaactcctgaggcttgaatgggattctgctcatgactatctgagaccctcaggcaggtcattcattaacctccctgtgtcttggtttcccccagacatgaagaagatcaagtgaaatgggcattatcttgtggatgtctcgatgtctctcctatgcactctcaggacacggcccagcacagggcacctgtttgaggtggtggtgttgctctcattgttttcttttgcttctctgttttgataggacgctaagtgccaaaggaattatttaactcctagcagctggaatctccctgctctcaggttcttaggtttacaaaaagaactgtcttgacaggcaagttcctgaaaacctctgttctgtgtttaaatcctgatgcacatctttgctaaaccccaaaactagctcagggtactcctgggacctcaggacttcacgcagagcaaccaagaaaaaagacacttccccattgccaccaaaacctcctggccattcattctttagagaacagggcccagaagtgtccatggcactggagttgtgtatgtggggaccgtgaaaggaaaataaatctcaggaccccacaatcaccaagccaaagggaagcatgaagctgggaaccgtgtcagcaaacctggcttccattgtgcttctaaataagatagccgcaaagattaaaaagctacctacctccctcagaatttgcacacacagagattccttgtggacctcaagatctttatcctaaaacagttccgctgaagttcacccaggcaatgtaaattgatcgtttatcttcacagggatgggacaaagaactcagctcctaaccctctgctcacccgagacaaaggtatatctgattgtttcttctgccctattatttatgcaaaaatgcagattcaatgagccagactaaggcacaaatgacaattcctctgcctccctctcacatggaaattgtgtattcagtgaaaggctcatcagagactcaaaagaatgcaaccctttgtctcttctctacctattgaaaccaccattgcaaaatgataactgagacagtgaaagagatctgacctaactccatcgtgcttctaacctccaagctgtccttgttcattcctgggtgtaggctgaacgaactctgtgaggagcttagtgtgtagtttagctttgaaacaaagaagataacagccctttcccaaaacaagcctccttccctgcctggaaataagactgcctttgcaggactaacaaattggccacaagactataaattattgtttaagagccatgcagctagaggctgaaagattctgaccctccccaaattgctcctggagataacatcactattgtaaaacctaagatcagttattgagatattttgtagaccctgccctctatggatgaactagctcatctggtcttgtggtccccacccaggaactgactcagtgcaagaggacagcttcgaccccctatgatttcatctccaacccagccaatcagcactcccaactcactggccccctagccaccacattatccttaaaaactccagtctccaaattctcaggaagactgattgagtagtaataaaactctggtttcctgtacagccagctctgcatgaattactctttctctattgcaacatccctgtcttaataaattggctgtatctaggcaacgggcaaggtgaacccactaggcggttacactatgacccagaagcccccgcttcaagttgtctcacctttccagaccgaaccaatgtacatcttatacttattgatgactcacatctctctaaaatgtataaaagcaagctgtacccagacagccttgggcacatgtcatcaagacctcccgaggctgtgtcacaggtgcgtccttaacattggccatgtcctgaattgattgagacccatctcagacacctttggttctccgtgtgctcaggcattttatgtaacatgtgttctggggtgtatcctatctaggcgccctctattgtatctggctgagcatggaagcaggctgcccagtggaatgttctgtctacagaaagtcacgaatatgccccattctccaaggacacaaacacctagacatgaaacccccactgcacaccacaggtggttctttgatgggtgagtgggtgggacttgacagccatggtttcttggtcaacagctgcagtgttgggatcaggttcccaaagtgctcaccctgcaaaggccagggcttcccagggaacgcactgctgaaaatactctctgcttcccaggagctggcctcacaggctccctaaacaatgcttctcagacctcagtggcatgagaaacatctggaagggtgattacagccaaccttgggcccctccctgaggggtttggattcagcaggtccgaggccgggcctgagaagccactttgctcacaagctcctgggcgctgctgctgccccggggaacccacttagagaaccacttgtccagaagtgggaaaggccgttccttccacgaactcaccatccaactcagaggcgtggaaaactttcaaaggcctgtctcgggggcaacccagcctctcctccaccccaggggaatagcaagggggtggtctttgacagagaggagcgcaggcagcctccctggcctgtgggaaggagcttgctgtccacacaacgcagaggcagaacggaaggttgtgaggctcaggcgtgcagcttgaattctgatgaccagtaaccgaattaaccgaattcagggttatccgctaggctctctcaacaactctggcccaaggatagaatcaacccacaatttctctcctctgcggtcatctgaaccccaggactgctctcccagcctgacagtcacagccttggcaggacgggaagagccatgtgtctgggcctgcgcagcacctcagcgagcatggcgttgcatttgacgcccggatgagggggaggccctgcttgtggagctcctcggagcagctcctcagctcccccaggctgaggaaccccgaccaccccccacctgcgtcagaagctgcagttcaggaagcagaggcaggtcagagcaggcccaggactcatggccgcgtccactcacgggaaaagcatcgccaagcacgccgggcagggaagatgctattctctagaatacctgcatgctgtccaaggtgttctgcgcgaagagcaaagcaagacagttacagaaagacgccgtaaataaaagacacaattcccagcacatccgaattgccttgtttttcgaaccaaagcacgctgcgttgcgaccgtcaccacatttgaaagcatgcaccaccagcagcacggggtgacaggtgacagcgggatcatggtggagcagtccctcagaggcggattgaagccacacagggtcatgtcaatgggctccggggcaactggggagaggcaactaccttttctgccaggagacgatgcaaattaaagtgcggtggataactcaggccagggaaagtgaattattttccagggagataaatggccatttggaggtctgtttctattctcccaggttatatattttcctatttgctattcatcacactcctccctccagatagtcattaactaatggaggctttcagaaaatccattttaatatataggatgataatgatgaaaccttttcctgtgggaggaatagactttaaaaggcaacgtaagagatgcacatagcccgttttaagtggctgctgctcccccagggacacaggacaaggtcattctgaagagggcagcctcatccaatattggcctcacttaagggaacattaccgggaggacgccaccccagggcagatcccctccgaggtaaatctctccttgagggggtggtgaattacacgatccttgacttcggcaggtgggggccccagctcactgtagcccagccactgtgcatgatggatgcagacagcagaggcctgagggggaccccatagccctccctgtctgcctggctactcactcccaaggaggctggcattggaccaggagccagggacaggggtggtcactcccaatacgccactcacgcaggtgggacgtagccgttgtttccttcccaaggccccagtgggaaacatctctgggaggcaggagaaggccactcatgtcgtgtttgcgaggaccacacccggggaagtgcctcagatggcgctgaggactctgattccccaggccctcctttctctgatcctacaaatgcctccccaggatgggtgtcataccttaaaaaggtaccccaaggcagttcatcagagaccaggatggcctccggaaggtccaccggcctttacccctggggaaattaattcacaagcaagcgagtgagccacgccccctcactttccacccaagaggagccaccagaggacagcagaccacatctgagacacacagttctgggtctggatgtgtggccaagggaaagctgcttaacctctctgtgcctcagtttccctgtaagaacggacctggtcctggcacctgtagtactggttgcttgtgaggatgacatgagaagacacatgaatggcatctagtaactggtgcaccaggcgcacttcataaacatcatctattatttctagcaggcatcagggcaactctccccaacgtcccccacccccgggcagaaagcaggggcacgctccttacctctagcagccgcactgcgccttcatgctccttcttagcctcaacctgagccttttttatgatgaaaagagagaaaagagtaaatgtccaaaggggaaagaagacaatcggatcaatgtctgaatcactgggggtgggggatcatttatttttattcctctaatagaggaattaaaattattcctacattcattatttaacttttatttgagtttcagaaatacatgtgcaggtttgctgtacagataaattgcacatccagggggtctgggacacagattatttcttcacccaggtgataagcttagtagcagaagcatccctccaatgcctctgacagcaccttcatctgcccaaacatccgacgaactgctttggaaacaaaacctaatcctgcagacttgactcccagtcagctctaggttccctgagacctcaccaggccctggaggaggggccggggctgggtcctgagcatgcaacaggccttggcacctgcagcctgtggcagggccgccctcttcaaagcactggcggcaaagccatctgggccccacagaataacttcacatgtttcactacagaaatgtctcgggatggctgctgcccaggcaaagggcagattcaagcacatctgagatggaacactatcatttcttgtcctcacaggcctggaagtcccagcatcaaacaccgttatttcttgtcctcacaggcccggaagtcccagcatcatcatgatggtaaggacctgtcgtgtttcaatggctttgatgttttgaaggtccttgtagccctcggcatagttccttgagtctcactaacttttctgcagacctaacgtttcaaaagacccatggaggcccctcactctgctccatctaagccaatgcccgttgtcccgtcacagtcgccaggggcctggacggcttattgctctgtgccccatctgacccagctagatgcccagcacttcggccacagggaatctgccctcccttctgtgagcgccatccccccagatgctcctgctgctcctgctgcagggcctgcccacctcctggatagcggatcctctgggtaacaggcctgttcctcaggcctcttcctccagcgtcaggagctcctctcctgggaagaacctctggactggctggggtctggacctcccctgtgccaagcacagtctgaaccctcagcgactggtgacctgggtggtgtggggcctacggagggcaatgggcctctgcctgagaatgctgcgggagagggaagcccctttctattggactttggcttgggaggaggtgaggctgcagccactttgccaccaggagggtcagggctggagtggctgggggtctccacagggaaaccaaggctgaagctgatccagaggagggcagagagcagccaagtcctggtgatgtcggggaggccttggattctactgggtctgaggccagcagatttgagccctggatctagccatgtctgaagccacattttcagtgatgggcacaaaaacaatttcctgtttgggttttctgtcgcttgaaaccaagagtgctaacgaacgtcatcgtcaactgtgaaagcatgggacacttcctaaagtgcggacactggaggttggttttctgaggctgtaatgagacagagaagaaaagacgaaccaggctcccgcctgcagcacagtccacactgtgcacccctcacactgacatcagcatctcccaaacattccccgtggagcaggaaaatgggggtttttaagaagcattattttctgacaccagagtgcacctagctcttaaaacgtggaacactaataaagaatccatatgctacgctgtgacttacatttacaattctcagtttctagagaaatatttcctctagctgcctggagaataattagtgatggacgattcaacatcataaataagcaagtgaacattatcttaacagtttctacttctcattctcaaaattccgtgcgctgaaaacagggaagagcttggcttccccagccaaggggaaatctgccattccctgggctaaaaatgaagagtcgtctgaggtttctgtagagttcattcatatgagttccattctcacatatttccaatgagagttttaagagctgggcaagtgactggaacacagcatgttaattacaccattctcaagttcagctcaaccgtcgaaggccgaaaactgttcctttcaaagcaaaaaccagcaagagcaacaataaatagcaaaatagaaaaagagacaaacaagcagggaacatacagggattatataaatgatgccaccattgactcagttgaatcaaagatagttttcaactggcaggattgaaaaaaaagacaaaacaaaaaatattccagcaggctgttaaaactcagccaagctggcagtacaacttcgcttccagcttcagatgaaaaccagtgcatttttgcaggtgcaaactgggccatttgggcaatcagaatagactgttgaaattggcagcgctgaattcttacaaaatccaagcaacagcttaagcgaggctcatttaggggccaacacagggaaagtgcgacctttacggagagtggttcctgcagagcagggagactggagctcccgacgctggaggaagaggcctgaggaacaggcctgttacccagaggatctgctctccgggaggtgggcaggccctgcggcaggagcagcagcagcatctggggggatggcgctcacagaagggagggcagattccctgtggccgaagtgctgggcatctagctaggttggatggggcacagagcaataggccgtccaggcccccggcgactgtgacgggacaacgggcattggcttagatggagcagagtgagggaggggcctccgtgggcgttatgaaacgttagctctgcagaaaagtcagtgagactcaaggaactatgccgagggctacaaggaccttcaaaacaggagttccgcagagctgagggctgatggacattttctaatactccaggagcacacaggattagggcagacactgcctgaaactaacacagagggtcagctatgacccaccgcagccatccacacacaactgaggccgacaatctgagggcagcacagcaaattcagtcaaagcattaactatgcatcgggcggtgagctcagcttctcttagtatcacacgttacataatagccttaagactgaaagcggtcattctaccagtaagaggaactgtagaccgaagtaaaatcggtcaagtctgcggatgaattataaatacggaaaagccctttagctcacaccactggattatcataattgccacttgtcacaagacaaggatgtaacctacacaagaaactgaaagtctgaagcaacggagcgcagccggaccccaggctgaccattcacctggagaggaagcctcagggtttcagaatcgggtctcaagtggaccacgggcatgttagcctcagcctccttatccgtcacatggagaaaacaatggtgcctccgccccgcaggttacacgagggctgactattcattgattccctccacaggcatttactgaatgttaatgagaatttatcctcggtcatcttatctgcgggattttgaccctactgccccgactgacggaacctcgtcacatctccaattccttctgtgcccttgagcacctccgcccatccaggatttgctggggagctcctaggtgtcaggcgatgtcctacgagtccgacgcgcctttcacggagctgaagtgccaacaggtggaggtgggcagtcggcaaacagccacatgagcgagcaggcatgttttggcatcagtaaatggggcgacatgccctctgtctgggcatggagtggcgtctggtctgagggagactcagtgagagaaatgaaccagttctgcaacaacctggggaccaggcattgtcgataagggtccccaagaggggactggctttggcacggtccagggagaggaggaagcagctgcagcatggggagcgggaggagtggcagaggtggcacagctcaaaggaggccacgactgcactccgggtcccagcccggacacgctgcaccagcagatttgtgcccagagtcgcttctaccatcgtcatgaccattcacagcctgttctcacaccgtcccactccttgctgtgttgctgggacttcactgacatgagacgctccgtaaacgtctgttgagtgaatggacgcagggatttgtgaatgagctcttgctcccggtctccaggaagcacgcgtctcccgggagagcctgaggttaccagcagacagcgtgggtcctggcttggctgccttttgcctttttaaactgtgtctctgctcaggtcccagagacgagggctgcagcatgagctcattgtccctggattccgggaggagagccctgggcactttcatcactcattcgtcattcacccatttgtttatttctccgatttaacaaatgctttccctttcacatgatcttacgtgcttctcccgaccgccatgcagggcaggaggacaggtggagctgcctgggagaaaggtgcctctggacaaggtgctgggatgcaggcccctgatattagacgcctgaatgtccagcaccctctcaagggtggtcaggtctgggggtgaagctgatcccaccaaggaatctctaagtactgcacaatgtggcacaatccacctgtatttcaggaaaaataaactcctgcctcacattgcacatcaagaaaaacaacattataggatggaggaagctgaggatgaaagcacaaagaggcagggaggagacccgcagacggtggggaggggcatttccaggacctggactgaaggaagaggccaggggctccaggcgggcgtctccaaggggaaaatggaatcagaagccccccagaggactgagactctcttgagaggaattttacagcttcagcagggtattggggaacaaaggaatgatgggtacacagagaagtaagacaacaagcaaacaaaaaaggcaattaactccagggaaaggaagagctgtacaaaaacgggagatgctgccgtttacggagctcaaggagttcagcagaagtgcaggtgttggtgaggacagaggggagttctgtgtgggacgtggcgtccgaggccccccaagcagtggtgtcaagcagagggtgagtaaaggaattggggcacagtggcatcgtctggcttccgggtctaaacccgggagttaccacgcagaggtggtgctgaaacccatgcatctatgtgaggtcatgagacagtgagtatagactgagaagggatgtgacttcaggactgagtcttagagtcacctgtgatgtgtagaggggctggtgtggagaaggaaaccaggagagggtggtatccttggaggccataagctcaaactgggcctccgggtcaaagaaaacgaggacagagaactacccactggaccgtaagctcatgcatgggtgacactaacaaaagccacttgttgggggtggggtcccgtgacggcaagttcaagaaagagctggggttgcagaaagagagaagagggtcactcctttgagatggctccacagccctctcatcagaatcacctttgggccttggagagtccaaagacgactggtgacttctatcttggtagggggatgagggccagtcttcagctaatccgtgcctcatggtgcaggcaccactgcctggtggggtaagcactccagctctgtgcctcaggcccaaattcaacccctgttccctccctggctgcaccccagctacccggccttcttcctcttccctggatgcgctgggctggttcccaagggggcctgtgtgtgctgctccctaacccttgcacactcctgccccagccctcggcgtggtgggtgtcatctgctccttgaactgtcacctgtatctaaagtcacggccccgtcaatccgccactcaagcctctcaactcccttcaccccttgccatcatctgggcttactcgctttttcactgacttgttcgtcttccttttttagcctgggagggcagagccgtgtcccactcgcagctgtgttcctgcttctggaacagcagctgagtggctgcttggaggggcagacggccgacccctgctgaatgacggtacgacggagctggtcacaagtgcagtgcaacgaccacccacgtggaaactgaatgcaaagatgagctctggaaagaagtcccggatctcattccactcaagagtcagacttcctcttctcatgcttaaaaactacatcaaagcctctagaaattacaaaattggcccattcatatttcatccagtttctctccctctgcccctcgccccactagtgaagcatcagtgtgtccaaaacagagacaatggtgagtgcggggggataaagaacgccaagagaactggacagcacacagaagagatcgtggacgcggaataacagagtcagttccaggtcattctccttggcatcaaatgcttagtaaatctaactccaggcttctagagaatgttctgttgagaggagacatcctttccccttcctggacagtctctgtgtttctacagacttatatctgtctcagacggtccccgcctggggacgtggcttctggagtgtgacgaataagtgcaggtgccatcaggcgtcacccggccacgggaaaggtccttgagacatggcaggagaacataagagtaatattcctgcccgtgtcccagcaatatcccttgcggataacatctaatgaaatattgctgctccgggtgcctgccaccttattatgacaggtaataagggctgtgaagttcccatcagcgctggcttaatgaaatctatccttaatacgatctcatgctaaatgcttagagaaatggcatcagaacttatctacctgtttccacaagctctgctaataaactctggaggagaaacgctgctccggcagattcctatcgccccccaggctgggtgaatgactgtgagccctttattttgagatccaagacctggataagctgtcggatggatcgaggggccacctagggcagaggagtggcccatcccagccagcaccgggcgggaggctgcagaccagccagctgcactctggccacaggggtggctgccctgccaggaggaggagagggcagggctgggtggggacactgggctctggaaggaaatgagatgagacctgttcacaggtccccaccttctgatttcttcctgggggcaccccaagcccataggctccgggagcaccaccctcctacctatctggagagagacagcaggaccgtggctgaggactggagtggggtgaggttacctttctcagtccccagacccatcacaggtgcccaggaggtaaaaatcccaaatcactcagtccttccttccctccttccctggtgcctctctcctttctctcctgatttcttttcctttctgtcttactcatcttgcctttttcctttcttactgggatccggctataaatattgctctgcaactcagttttctcacttgataacacatcatgcaacagcctcaagacagcagaatcaaaccaccatgatccttttcgctgacatcacacggcgcctggtgtggatggaccatggtgcacacagccatcacccttaggtgggcatcaattgggtccagtccctgtccccactgccacacagcagcactgcaagaaaacaaaactccttttgaactggttcctgtactccttgcagggcatcgtccaggatgggggtggcagggtcaccttctgtgtgcccttttagtttaaacggatgctgcacactgctttttccagaagcggaagcaattcacaccctgccagccatctctacgcatgtgtttttcccgacaacctcaccagcatcagaggttagagctttgcatctgctttcgcgttataaaacatgaacacaggtctacttaagaaacaccacagcaggaaagcagaaatgactctgaattcttctgtgcaagcagagagagggagcggcctgggagccaaggccgcaggtcggccgctccaccacaccagggatccccggcccacccgtggactccctgcctcgcacgccgcgcccggctgcccgccgcttaccttctgcagaaggtcaatttcctgctgcttggcactgagaacagccagggcctggtcatgctccaactgcagctgctgccgccgttcagccgcctctcgcatatgctgtggggacagagagaggcctggctgagcagggcagcctgtgcccatgggcgtgcatcctataccctgcaccaagctggctctgactcagcccggtcactccagagcagcccctcaccgccccacagggcacccacctccgtgctgccaacagggctcctccagaggcggcactcccaatgcgggagctatgacataaacaagccccccacctgccacttctcctctgcaggttccaaatgcagcgagcatttgagcagaactctgtcctcatgcaaatgtgactttcgtctttttgcttgttttgaaaaagtgaatctccctcctgtgccttttttgcccaggtcctttgtatataacagcaaaggcttattgatgctgccctgtgtgcccagcactggttcagggttttatctgcatttaagtcatatcatccccatcataagcctaggaggtaggttctagaagtagcctcattctacagagagggaaactgaggcacaggatgtcatccttgcccatcgggcagctgggaagtggacgcctgttcagaatgcaaacccagagtccgcaccctcccgggagcttcccggcctcgggccgagtccgcaccctcccgggagcttcccgacctcgggctctggtcctgactgccgactccagtgaaccagcgcactcagacccaggagtccaaattccttcacttacccctctgggaaagtcgcaaggtggcccccatcagccaggcccattttctgcagcagagaggacagagccgggttcctggctctgtcctctccccctgacaatccgtctgtcctgcttggaggggcggtgcttaatccccagtgctcagggtttaactctcacctatttgccctctgcgggcccttccctcccctctgacgggtctcacgagcccagagtcaccactgggaccctgacagtgaggaccaggcccccagacccatgaagctcacagcagtgaccagccacgaaccctggcagcctgcaggaggaaacacatgggaaatgacattgggtagaaatggccacagcgggcgggtgggtagtcacactgggaacagtcacagaaaacatttcctggggtccccaagccactcctgggggcttggaaaaccagctgcaaaatgctagaatttcattgtcatttcctttcatacacacacacacacacacacacacacacacacacacacctgtggtaacttcgtggtcaacattttaaaatctgggtcttttatataaaagaccagattccttcaaaaatgggaagagttggccacgcatgcctccaggaaaggactgagaagggagtgggagctgccccttccgatggcatatacccccgatgtctgcggccccacgggcctgccccccatgtcccctgacatccgagggccacacagatgacccaggtcctaaagcaagtgggtgtcttggccccagcgagccatgggggacccacacgccttcctcctgggctggaactggttggtcatttattttttattattttattattttacaattccattgatttttagccttttactcatttttatttatttttatttttttgagatggagtcttgctctgtcacccaggctggagtacagtggcaggatcttggctcactgcagcctccacctcctgggttcaagctactctcgtgcttcagcctccctagtagctgggattacaggtgcccaccaccatgctgggctaatttttgtatttttagtagatacagggttttgccatgttggccaggctggtctggaactcctgacctcaggcgatccgcctgcctcggcctcccaaagtgctgggattacaggcgtgagccaccgcgcccgaccaccttttactcatttttatttagttttggagtcttaaaggcctgtagccttcgcaagtcatgaggtcggacacacgcgtccaagagaaggttaacgtggtttcctgaggccgctgccaactcagcctgagctggaaagaggagcctggcaggggggaggcgagggagtccctgctgagactggcaagctgtgagggcggggggcacccaggctcagggggaggggtgtggcccctcgggaggaggcaggtggtgagggcgggggcacccaggctcagggggaggggtgtggccccgcaggaggaggcagacaggctgattacattcttcttgccagttttccaaaggtagccctactgctaccttttttgctgcctctgaaagctcctttcttctgggaaagatcttgaaacagaaccactttaactgagggtggggaaagcctccacttttcattctgcaaagcgctgtggttggtgggatattttgtttgtgtttaaaaagtgaagtcttcctcccggcccgtgtttcaggcacggcaacctcacgtgctggttcatctacatttttaagctgaataaactcggcatcctctctgctgtctccagaagaggctcccagtgaactcagaagctggaattaccctgcacccccacagacatctgggggtttcactgttgctatgggaactctcacaagaacccgggatccggagaaaatggagttccccaaaacatgaacaaaaccccatgaaacacgggtgtcgcggtcagtggccctcgccagttcactctggggccagatgggccccagggaaacaccatgcttgtatcttcccacgtttactccagctctgagcctgggcaggcctggccctcctgggaagaagccctgggtatttgctgcacagccctcccgagatccgccctgacacactgctccccccgccccgctgggctgtcagcccatttgggcctcgccatttctaacggtctctttccaagagcctcagtttccccccgaccccccaagccgccaccaccaccaccacccaccgcccaccaccagttcactgtgagtgcaaaccagctgcatacattgcagggcatttttaggaggacggggacaagccaccaagacaaactgacagagccctgggggatgcaggggattccccgagctcctgagacgctttgggaactcttctccaaaccctggctgccacctcagtgcggtgtggctttgctctggtgtcaggtttccccatgagggtcccagaggtcctcaggacggacagtctctgcagaccctcatgaggccctccgtgtggggcttccagctccagagaggactatttctactccatttattcattcattgcttcttctggatattggttcatcggactggatttattgagcacctactaggtgccaagaagctggggacacagaacaggacaaacgtgtcttcatgagagaacaccccagagtgggggcacagtgtgaaggcagatcgatgaaacgagaagggcccgagtgtggcacggagcaggatggaggcacctaaatgacatctgtggtcctggacttcaggagtggccatttcctacatcctaacaccagcctcaatctgatacgaggaggagatttcagccagattccaccaggagaactcgctcactcaactcactcaacaaatacttacccaagcacttgttttgtgccaggcaccctgctggcttctgaaggctacagcaacgcaaaacaaagcaaaacaaaaccagctctcttggagctcacattctgcaggggagggggcacacctcatcccaatacacccattgtgtgtgtacatgtgtcagattctgcaggggagggggcagacctcatcccaatacacccattgtgtgtgtacatgtgtcagattctgcaggggagggggcagacctcatccaaatacacccattgtgtgtgtacatgtgtcagattctgcaggggagggggcacacctcatccaaatacacccattgtgtgtgtacatgtgtcagattctgcaggggagggggcagacctcatccaattacacccattgtgtgtgtacatgtgtcagattctgcaggggagggggcagacctcatccaaatacacccactgtgtgtgtacatgtgtcagattctgcaggggagggggcacacctcatccaaatacacccattgtgtgtgtacatgtgtcagattctgcaggggagggggcagacctcatccaaatacacccactgtgtgtgtacatgtgtcagattctgcaggggagggggcagacctcatccaaatacacccactgtgtgtgtacatgtgtcagattctgcaggggagggggcagacctcatccaaatacgccgattgtgtgtgtacacgggtcagcagtcctaagcaccatggggtcaggcggtcctaagtccacaaatgcacgcacctactatgcagccacaaaaattgtaaaaaattaaaaataaataaataaaaggggagaaacagaaaaaataaactgctaaaaatatacttttactttttataaacaaaggggatgggagctgcagtcctgctgggggctggcctgtcggctgagaaggccaaggaagccccccaccaagatggtgctaaacaaaggctcacaccagagacagagccccacgcggctgtgggtggaaggcgggatacacagtgcccagagcccccaccctcacctacacacagtgcccagagcccccgtccccacctagacacagtgcccggagcccccatccctcacctacacacagtgcccagagcccccgtccccacctagacacagtgcccggagcccccatccctcacctacacacagtgcccggagcccccgtccccacctagatacggtgcccggagccccgaccctcacctacacacggtgcccggagcccccaccctcacctacacacagtgcccggagcccccgtccccacctagacacggtgcccggagcccctgtccccgcctagatgtgtccctgagccatgccactaacaggggctgcgagggcttccgcggctcctggaaaggccccagaagttcccccaggcactggcttgctggcatggacaatgtcccatgggaaggatagactggaggcgaaacatctctccagagtctgccggcgactgtcacttaggtgtccttggccggaaggagcccgatgccccccgaagtggacccctggccccatgtcgcatcccagctgaaagcccctcggtggggagtaaagcggcatgctgtcacagggccacctgactgcctcttgcctcctgatgccgctgccaccaccatctgcctgcctctcatgccctgctgtaacaccctggctttcgcgctgtttctaaagagcagaccagtgcccgcctctggaccttcacacgtgttgctctccctgctagcctgactctcacgttccagcctttgcccagatgccacttcgcactgaagcctggtggccgcccggcccctcctggatacaccatgttctccacctgccttattttcctcctgagcatcctcatccccagtgcactggccggctcccttgcctgctatctgctccttcccctggaacatgagcaggcaccttgccccactgtgtccctgtccccacaatgggtcactcggcacagatgccaaataatcaaactgccgccttcatggcctcttggagctcagtcccactgctgtccccaccacccccttctccagccacatgggcctcctcccagcccctggagctctccacgctgcccacatcaggggctggcagggaaggttgggggaaaagtgcttccagcatttcaggccagcaaaagccattaaagagcctgaacacctgggctcaaatcccagctctgatactggcccgctgtgtggtcttagagtagttacttaacctctctgttctccatgttcttcttttggattaatttttcaacactattctttttcaattggttagtgattagtgaaataactaatgttgattattaattaacacccacttcatagaggtgttttgaattttccttggcatctattaagttctctgtgttatgttttagtcccaagaggagaaaaccctttcccactggacgtgtgtagccctgtgtgatgtcacttaaacaccaggtacagggtgggagggagggactcatgaggcaaccagggctgcaccaacaggatgatggacagctaccgccgcattggtaaaatgacggtgagaaatcggaatgtggctgctgtcatttattaagcacctactatatgcagggcactatgcttgcccaggcactgtgtcatttgaggctgagggttgggtgctgtggtcactgcatcccagcagagcaacagactcagggaagctgagcaagggctaaaagccacagctggaacatggccgatgagaatgtcagaactcacagccagtctgctcccggccactgccccacttctgggttgagatgacttacaccagccactgccatcttggagcactacgggggccagggcagagaagcagctttcgacttcctcgcggcccacctggcctgggtggccgattgtgcagctgcttaattctgccattttggcttaattctggctaattttgtgcttctctttattttggaagggggcactgccaaaggcagactgtatcatctttatttagttctgggaaggaagttgttagcgagaggagggtgccaccttccctaccaggactcgctaggtagattcaccaggcaccgaaacagctccgggcgtggtcctgcggcctcagagtcactgaggataaaggggtggcggatgctatgctgggctcttgcttcggggtgccagtgagatgagggtttatagatcagatggatggaaacaagtacagggaagaagtctttgcatttctacggttaatgaaccaagtccgtacaaagcagctgtcagaaaggcgtgagcgggagaagcactcggccctcgaagacagcctcagtttcatcacagatgccatggctgggaggacaaggtttgctggggcttgttttggcttcagcatctatctctccaaatcttacctgtttctgcaaagccctcatccccctccagccactgcccatgtatctgcctcccatctcacacgctcttccagcccttccagtcagcctccctcctgtcactcggctgagattctcccactaaggcagccgaggagtccctgcagcccgaacccatggccactttcgtgccctgactggaccaaatccctcagcagcacccgacaccagggctgctcctcctggacatgccctggactctggcccccgtggggcgcgctgacctggtctctccccctgacctctgcaatgacctcccgctgatctctaaatcctggaggggccacggctctatttataccattccttaggtgatcttagccagctttgaggttttaattgccacataattccaaatgaacccttcatccccgtcccccgcccccccgccactcatacccaactgcctactcattatccccacatggatgtacaggaggaagctcaaatttagcctgtccgaaatagaattcttgattttcttcctcaaacaagttccctccccaagctgtgccatctcggccaaggacaccatcatcccctcagctcctccagatgcaaagctgacagtcattcttgacttcctgccccctttcccgccttgttcaacatccagatctttgagaaaaaaaaaaacctcccaatttaaaaaaatgtgcacccaaactccccccacccatgtctgccgttctctcctgtgtccaacgctgccacctcatctctcccctagactatggtagactacggcagaagagccctttctgccccgagacagctcctcctctcccctggaccataaccagctcctcagagccctttctgccccgagacagctcctccagagccactggctgcaccagagattgccccacagccattctccttcaagagcacaaaggctgccaactgcaccgggaacaaaatccagactcctggctgcagccaacaggctcctctgtgatccagcctcttctctgccctcacctctcacctctgccccttcctcactgtgcttttgccacactggcttcgctcagttccatgatcacgtcaaggtcatccccaactccaggtcttagcgagtgccattcctgctgtccgacatgcttgtccctgcatcaccacgtggccagcccttcacggcgtgatggggtttaggatgtgttccctccaaacctcaggttgaaatgtgacccctgtgttggaggtggggcctggtgggaggtgtctgggtcacgggggcatagccctcatgaatagcttggtgccctccccatagcgataagtgagttcttgctctgagttcactcgagagctggttgtttaagggagcctggctcctcctccctgtctcttgctacctttctcaccatgtgatgcacctgctcccactttgccttctgccatgtttggaagcttcctgaggcctcaccagaagctgagcagatgctggtgccatgcttgtacagcctgcagaactgtgagataaattcgcttcttttctttacaaaatacccagtctcaggtatttctttataacaacacaaaacggacaaagacatggcaagtgtcctgaccagtgaccagagattattttatttacgtgtttattctatgtcatcctttccatcccactccctacccttgtccatgagaaccacaggatcacaggacttgtttccctgtctactggtgcacccccggcccagaacagtctctgacacatggtgaggcagaatcaatgacagcaaaggtgaggcctctcgcctaaaacatctgtcccacgcccccagcccacactcccctctccatccctcacagcctcccacatgactctgcagcaatgctgtaacctgcttggtaccgttctaattccatgtaattctcactttctcaactggactagaaatggctccatttccgtgtgtgcactccacaggcaacaggagtctaattaacattttctaagtggaattaaagcaatgattttgagtggaggattcatcctgtggctgtctagaaactagactttaacacttgaggagcctagagaagattggatcctcactaccaaagattccacatttcaccaaacccacagtcaaaactgtgaaccagagacataagctggttctcctggaggccatcacactggcggagttagtcacgcagctataataaaacatctctcggagatgggctttgagactgatgagggtagagtgaagtggatggcgaaaaaaaagtttaagccaaaaataggagagatattggctgcaaaggctgaaattcgtggtgttaggtggatggtaggggaaaagatagctcagtcagggggtggtgggggccgtaagtttaatattagtgaggtctacgaaccagccaaaaaaaagagaaatggacaaggctcacaaacacacggacatgctaaatatatccatccatcctggcatgaggacatactgattcattctgcacagcgttacttttctaaatgtagccagtgtgcatgtctctgttgaaacatctatagaaaaatcagtgttgcaaggctgagatattaatcaatgtttctttctatcactaaccctctatttctcctccattcccctcccacttcccatcctgagggctccattccatgctcactgcctcagggaggatgagagatgggtcagggaagagcagaaactggggactcccctgggctttggtctgcagagataaggggaatcaagaagacagcatacagaggggttactgtgagaaactgagactagatttcccttctaatctgcagaaatatattgcttcaccagaggcagacaaattagctgagaagaaccgatgcatgtatagacactggtggatgggctcttggctctgctttctggaaagttccagagagctgactcctacagaattcacggctagcatggggagttgagaaaatggagcttaaacagcctggcagggatttctgaacgaccctgggatagctaagagcccacgtgaatgcatacaactaaacaattaaattctttcatgtcttatattttacaatgtcttcaagtaacttttacccttgtctctgaaataatggaaacaactggtagacggtggcttgtctacttttacagcctacatataagcaatacgcatcggatagaatggtgggaatctgtgtgtgtacgcctggatgagggcaggatggaatcccacaacatcttggctttgggtcaccctgcaccccagcctagatctcaccttggtgtgccaatcaactgcctcaggtctctcagatctactctctctccttctcttgttttgctctgtatcagaaagagctacacttcccagacgccctcgccctctgcttctgggtggtcagtcaacaggcagcatcggcgggagggaagccagggatttctacccctctctctgcctctcgagctgtctcctgtagaggctccgtctcctgtagaggctccatctcctgtctctaacccacggtctctgctcctgactctgagatcatcatcacccccactgtcccttcagccttagaggtgatgccaggttcacaatgcagccatctggcttcttagttcttccaccctgtgtgtcacaatcccctgtattaatgtccctccatttgaaataccttggctggctcctgctttttgactgaagtctgaccggtagactgaaggaaaaggatgaagccaactccaaattgatgacacatttctatcactctttcaaaatgcgtgtcttaaaagtgaattaagcactttgggaggccaaggagggtggatcacaaggtcaggagatcgagaccatcctggccaacatggtgaaaccccgtctctactaaaatacaaaaaattagccaggcatggtggcaggcacctgtagttccagctattcgggaggctgaggcaagagaatcgcttgaacccgggaggcggaggttgcagtgagccgagactgcaccactgcactccagcctgggtgacagagcgagactctgtctcaaaaaaaaaaaaaaaaaaagataaaaaagaaaagtgaattaagtaatgttgagggggttgttctgtttctttcacttgagttgttgcaactggactcaaacctgcttcacagacttactgtgacaattctaagttaaaaaaaaaactcacggaaatgttgattttgctgaccacctacaaagcagaaaataaatctgtccaggaaaatgtacaatctgataatgtttttgtttacttatctacaatttagcttggattttttactatcccttagtttgcttgaaattttcctattaaaaaataaatggttttgatgcttcttcccaactaggaaagcttgttctggtcccagctgtcagacaatcccgggctgatagctactttaatgaatcagcagcagaagtataaatcggggtacagggagatgggggtgaagatagaggtgcttggtttacctcaagagttataacatcacggggcaaaggcaggttcggtaagttccagctgccatttctctccaagggccaggaaacaacatcttaagataaaagtcactggccataaacaaccttattcaaggaaaataatctcgtctgcagggcacctgtggtgtgaaggctgagacctgtgagttcagcaacagaatcggccaagtgggggctgcagtaaacccctcggcttaccggccagtccacaggactaaaagagaggccaaatgccaactcaccccggaactcagccacaccataaaagagggagatgtggtcagagttcagtgggagggtggggagcgaagtgggaagcggtctacacagcagctcccgagccccctgtgtgtagcaacaatcaaaacccacgttagtgtttatcacagatcaccacctacaaatggtgggaaaatggtgttcttattccggtatgcacattgctggcacagttttcccagagaacctgcctgagacccagcccagctccagacatcagcctccacatgctcacctaaacacatctgaggattactaagttctagaagtactgttatgctaagtactgaacacacatcacccatttaatcggcacaacaacgcttgaagcaggtgatatttttattcccatttacagagaaggaaaccaaggcccagagcggttaagcaacgtgttcaagtttgcccagctaggccaggctcaagccaggatttgcacctagcgagcccagctcactctccctccactgtctctgctctctgctgtctaagaggcctcctccaggacctctctcatatttgcgggatgtgctgatgtttgctgggactctcttcaaggcagtacacatgagaaccttttctgcagtgccctgaagtcactccgcctccttccttccagagttctcaggccaccacgcacactgttcgtgcctctgtcacagagccatctgcacttctggggggcaatcgcactttccttctcacaacttccacaagcagctaggagtctctcggttcctgggagtgcaaggggcccaaggattcccaaagggagtctgaaaacctcgggtttcgcccagagacagaatcccaccacaccctgacaccgggcttccgcctccccgcgcagagaccttcccagggcacgtgctgtcattcatgggaaggcttcacatctgaaaagtactcaggattatgcgccacggccaaaactgcctgtctgaaacgctctgcctgtggcaggatttatttttaaagcagcgatatttatagctgactgtcgacattcacgccagcacttaagctgcctacaaatgtcagggtgccgctatcccagggaaaagctcggatgtgacacggaacgaacgaacctgaagcaaactgaattatctcctcaacgtcagatcaaacgtggacttgtcctgtgcttggatgctgccttgcctgagcgaagaaattaaggaaaaaccaatttccccaaataggagctaacggtgacactttgaatgtcacattagtgggatctgctacgcgtggtagaaataatgaagcatttatgtacacacgatttgctttcacccagcacctggcagaaggaatgcaagcactcacagaacccacgtcttcaaaagcaagaaagacaaggtctttaaagctgtttgttttcatggcatcacgactgtctgtcctagtcacagaagtcacactcattaagaatgagaatgtgtgtgaaaaacattcatgtgaattcagtgaggtctatttcagcccaagtattttagtttctcaaactgggaaaaaaaatggatccttaggagttcctttgggggaaaaaaaaagagagagagagagagaaagattttcctgagtgttgattggtctttgatcctaaagcctccttccttctcctctggccctgatgaatcctagagatgcaggggtggcaacattcatccatgctgctttgggagggttatttttctcacacacagtttctgtcctgccccagtggctcccggctgtgagcccgggattttggccagccaagtagaggggatcttatcagctggacctgtgttcaatgccatttccaacacgtacaggctgtgtgccctggggtgagttaggtacctctctgaacctcaggttccacgtttattgaatggcaacaaaaaataccgtccttcctaggttgtcgcaagaatgagattaaatgttagattcaaagggatctgcacagaaccaggtgcggcagctcacgcctgtaatcccagcactttgggaggccgaggcgggtggattgcttgagtccagaagtttgagaccagcctaggcaatatggcaaaaccccatatctgctaaaaatacaaaaaattagccaaatgtggtggcaaacacctgtagtcccagctattcaggggactggggctcaggcaggaggatggcttgggcgcaggaggcggaggctgcagtgagcctagataacgcactgcactccagcctgggtgagagagtgagatcgtagctcaaaaaaccaaaacaaaacaaaaaaacaaagtgacctgcacaggaattaagtttcatgtaaatatcactaagttttatttaggtctgccactcgatttggcttctgttagttccctcccattttcattatttgatctcccctttcctgccttctttttgttttttgttgtttctttttgttcgttttgttttgtttttgagatggaatctcgctctgttgcccaggctggagtgcaatggcgtgatctcggctcactgcaacctccacctcctgagttcaagcaattctcatgcttcagcttcctgagtagctgggattacaggcgtgtaccaccacgcctggttaatttttgtatttttagtagagacggggtttcagcatgttggccaggctggtctcaaactcctgacctcaggtgatctgcctgcctcaacctcccaaagtgctgggattccaggcgggagccaccatgcccagcctggttttcaattttaatgtctccatggagtgctgttctgtatgtttttatgtcactcctagtggttgccccagggaactcaatatacatatttaaatttaaacaatctactcagaattaaaacttgccattccaagtggaattcttacatgctccatctatatacctgaaaccccatcacagtgttctacattttcgttgaagtgtcatttatgtacatgaaagagtctaccaggagaaaaacagcctggtctagcctgttacatttacccggatatccgccctttctgtttctctcctctgtccagtgtttcctgagcaccaactacgtccaggtggcccgacaggcactggagacacagtggacacaaagctgagaggccctggcttgtgtggggctgacatcccagtgggaaagacaagcgttgatcgggtgaggatataaaaatgcaagcttgtgatgcatgggtaaactgaggctcacggagatgactcagccccttgtgagtacatcccacactctgggacagagcgctcattctgtatcactgcgctggggacagggacagagcggttcagaaggacagaccccgccctggccctcctggagcccactccacaccccagcaagcatcaggcctagaagttggcacctccccgccaccacggttctccctgcactgctctgcccccgcctccacagtctcacggtaagatggtggatgcaaacgtgctttgaaagatgcaaagcacagtggctcatacctgtaatcccagcactttaggaggccaaggcaggcagatcacccgaggtcaagagttcgagaccagcctggccaacatgctgaaaccccgtctctactcaaaatacaaaaattagccaggcatggtggcaggcacctgtaatcccagctactcaggaagctgaagagggagaatcgcttgaacccaggaggcagagtttgcagtgaactgagattgccccactgcactccagcctgggcaacagagtgaaaccctgtctcaaaaaaaaaaaaagaaagaaaagaaaagaaagagcaaagtaggagtcaggtaacccacggaggcctccaggaccctgcactccagccctgtgtgctggttactcaggacacaccctcttccctgctgtccagagcacttggccttatgtgggaaaaggatgcatttgtgaccgctgggtcacaaagtaccacaactggcacttctgcttaagacaatggaaagtgtcctctcacagccctggagcacagaaggctgaaatccaggtgtcggcagggccggatcctctcgtggaacctctgagggagaagccgccccatgccccgctccagctgctggcgtggccacgatgcttggtgatctttgaccagaagacacctcactcccatccccttgggtgtctctgtgcctcttcttcttataaggacaacagtccttgggtttagggcctgccctactccaagatgaccttatattaatgacatctggacagactcattttcaaataaggtcatattcacagatacatagatttaggacttgggcgtcatttgggggaacacagctggccctctacatgccctgaaatgatgaggggggctgcttcacttgctccccatctgcctggattcatgcctctggacacctgccccagaccaagccatcagccacgctggtacatgccctagtggctcccgcctcagtgctgcccgttgtctcctcttgcccctgtgagatttccccagggatgttgcttggtcaggccactgtcatcacgtgggcctcagctgaagtgtcaccccctaacagacatgtgcagggtgccctgcgctcccctctccctccaggtcaccctggctcatcaccgtcttcctccgtctctgaaattcttatctatttgctggatgacctgattttttttctgagctcctcccaccccagtagaaggtaagtttcatgaaaacaaaaataaccttggacttgctcctcgttttactccaagcatctggcatggtacctggctatccttctgtctattctagtagattcctttgagggtgtatatcaatgaaattgctcacggtattagcaattcttgatcactaacctctccagcaccagccactatgttagatcactgggcacattctatgctttgaacccttacatctagaaaggtactttatggccactttaaagatgagagaacaccccggttctcagaaattagttagcttgatcacacgtaaacaactagttaatcatcaaattcaaatttgaactcagactggtctaactaaaagcccaaagtctttgaattaggtcatgctactgagatcaacgggaacgtccccctagggtgggtgatgattctgccgctgactcattggacctaaactgtaaagcattgtggaccacggcagagagtacgtccgtgcctgtagccatgtgatacggtttggctgtgccccacccaaatctcatcttgaatagtaactccagtaattcccatgtcttgtgggagggacctggtgggagataattggatcatgggggcggtgtcccccacactgttctgtggtagttaataaatctcacaagatctgaaggttttatcagtggaaacccctttctcttgattctcattcccttctcttctcttgcctgctcccacgtgacacatgactttcacctaccaccatgattgtgaggcctccccagccacatagaatggtgagtccattaaacctctttcctgtataaattacccagtctcgagtatgtctttattagcagcatgaaaaaggactaaaccaccatctcactgtcctcactccggtctcagcagccctgctgagcagctctggggtagaggaggctgcgaggggtgaggctccatccacttcctgcaggagggatgcttctgtccacgggagaccagcacacagtgatacctcatgaaaggccacgttcccatcaccctgagcccccttctatgtcgggcccccagcagctatggcgctgggcaggcccgctccccagaaagtgaccacatgatggtttcctgcctgtgatggcctccttcaggcacacctttctctcacctgcaggccacccagaggagccaaggaggaccgcacacttctctgcacactgggactgctgtcctctccctgaggagtgggaccctcaagttgttctgcccaggccatcagaccatgactgccccgatgtcactgagcagagtacagagagactgggatgtgtatacactgggggcttaaaacaacagcaacccatcctctcatgccctggaggccggaagtcttcagtcgaggtgtggacagggccatgtaccctccgaaagctccagggcaggctcttccccatcttgccaggctcctgggcgctccatggctctgatctctgcctccatccacacgtggcttcctccctgagcgtctgtgtctctatccaaactcccctctcctttctttccaaagcctgtcactgaacgagggccctccctgatgtgcgaccgcaccttcacctagttacatctccaaacacactatttccaaattaggccccgcgccccagttctgggtggacatgactgtggggaggctgattgaatctacccctctgtccagaagcttctcacctgccttctgctccctgggctccgtaatcactgattctgctcacagcctctggtgggtccaccagtccctgcctctaactgcttctagattgagctctctgaatctagaaaccttgtgagtgtgaagttaaaccgtccttccctgccaggactctaaaataaaagcagctgtcgctctaccgcatccgacgaacagaactgtctcacgggccatgggagaaggggctggagagatgcgttctggccgtggctgtgagcgaagcaccaccggttgcagtccctttacccaggagctggggagaggctgaggacccagaatgtcttgtgtatcaggcagtagaaactcacatgaaaaacacatgaggctttttttgttttgtttttttgcagtgagtaaaaaagcccaatgcgttttttatttgaatctgagaagctggagaataaaaagcattttgtttattttatcacaatgcactcacttctgacaggcaccctgcttcagaggagtgctgggtgttttgatcagactcctgtgccaggacctaagaggaggactgactctgggttaaatgcaacaaggagtgcgcggtggggagatccttgtctgacaccagcctgggctgaggagatgccggaaatcaccaactctcctgtgtttattccccttggagagtctctgtctattccagaaaggaactgcagattgatctgtagatgtgactttatacagtcacctgtgagccccagagaagcacctctgcagagaagcaccctgactccaggcctcctgctgctcggtcattctccatgaaggcagcactgactccaggcctccggctgccccgtcattctccatgaaggcagcactgactccaggcctccggctgcccagtcattctccatgaaggcagcactgactccaggcctctggctgcttagtcattctccatgaaggcagcaagtgtctgcagtgccggtcggttcagcgaggcaatctgtcaacccctcactcattcatgcgtgcacttgctccgttactaattcatcaatcaatcagtatttatcgagtgtctactatatgccagattttgtgctgggcactagaacaaaggctgtcttgaggatgttacattttggtagggaagacaaatacacaggcagacagttaaagcagacaagatgagtgcgctgaagaaatggaacccagtgatgtgcaagtgaccagcaagggggcctctggtcctttagaccaggtggccacgaaagcaacatgaaactgagacccaataagccaggaatcagaaatacaaagtgctgagggaaacagcattcaaaaaaaaaaaaaaaaaacactcagtgcaggaaatccgagctagcctgtggagaggccacatgaggagagaaatgtctggcctgccccctctcttccagccatcccaggagaggacaacatgcaggcaaagagccagccaaggctgcagatgattgcaacttcagttgccatctgagcgtaactacccaagtggaggccccacgtgagaaccatgtagctgcccagtcaacccacacagccatgagacatcaacacaaatcactaatctcagccactcaattttggggttgcattagtccattctcacactgctataaagacatacctaaaactgagtaatttgtgaagaaaagaggtttaactgactcacagttcctcaagctgtacaggaggcatggctggggaaacctcaggaaacttacaattacagtggaaggcaaaggaaacgcaggcacatcttcacatggcaacaggaaagagcatgaagcaggaggggctacacacttttaaaccaacagatcttgtgagaactcactcaccatcacaacagcaagggagaaatctgcccccatgatccaatcatctcccaccaggtctcttccccaacattgagaactacaattcaacatgagatttgggtggggacatagagccaaaccatatcagggtgctttgtgatacagcaatagctaacttgtatacctctgtgcggtctccctgcatctcctcttgcgtactacgtctctacagagttgcagatataattccttaaaaattcaggttagatcacatcattctactgttgaaaaccctctaatggcttcccatctcgctcaggaaggaaagagccaaagtccttatcttggccttcaaaagctttaagtgatctgctccaagtcatctccctcatctgacctcatcttctaactatttccccgtgttcattctactcctgcacctcgggcttccacacacttctcagacacagcaggcattcaccctctgccccaggacctttgcacctctgcacagctccctccctggcttcatccaggtctcttttcaaaggactcacccacagtgaggtctccccaaccactaaatgtaaaccagctcttccatgactatcactcttcgcctcttttcacttccccacctgacctgcacattaatttatcaactctctaccagaaccaagggcatggatttagatcactttttccagaaactagaaagcgtttgatgcaaagtggttgctcaatatttttgaatgaatatatctttaggtgtgggttcaattagatttctttatttttaacttttattttaggttcaggggcacatgtgcaagtttgttatataggttttaatcagggcaaggactgtaggctttgaaattcttcaggaagccagtgcctgaggtaaacaaatccatttccctttaaaatctgtatatctggacatactcttctgactcttcaagtgaaaattacttggcagcccccataatacggtcaaaaagggctctgtaaagaaccatgtgggctggatgcagtggctcatacttgtaatcccagcactttgggaggctaagacaggcagatcacaaggtcaggagttcgagaccagcctgaccaacacggggaaaccccatctctactaaaaatacaaaaattagctgggcgtggtggcaggcccctgtaatcccagctactcaggaagctgaggcaggagtatcgcttgaacctggcaggcggaggttgcagtgagcccagatcacgccactgcactccagcctgggtgactgagcgagactccttctcaaagaaaaaacaaacaacaaaaaataaataaataagccatgtgttgctgtgcataaccaatcacaggctgcagggaagcagggcacgttgtctttagctaaattgaatgatcactattaagacaggcggcacatcagtgatatttggaaacaaaaaagccagcatatgaatgtgaccagtgggctaattttcagttcagacaggccctgaatgcacattggcacagctccacagctgtaactacccccgttaacacaggacgggcagtcttaattcacaggccgcatgtcccctcttacccctcagtcactttaggacatggaagacacaagacgcgtcaggtgctagatgagaacggtggccacaggatttgggaacaaaggccgtggtgatggctgcctgagcttcatgctttaacccaagtgagccgcttctatcactctaccacacgcgtcatctaataatggaacaacatgggtttcttgaggatcagcagggaggtccgtagagtgggaacccggagctctcccacccgagcatccaggggtcacgacacactccatctcccacacgtggtgacgccctgaccctgaaccgcacatccccaggcttccctgtcacagcagatgacaccattgctgccccagaaattaacgtcctgactccttcctgcctctcacactccacgtccagtctatcagcaaaccctgttgattccaccttgaagacacaccccgagcctgtgcacttctccccaccctgccttgctggaagcccccatcatctcgcatcaggacatggctcccagtggggtccctgcttccactcctgttttttttctgtgcggccactggagtgaccctctacaaaccaaagccagatgcacctcctctctcaattccagtggcatctgacataaactgattgaaaactatgccacagtcactccctgcatctgaggtaggagggtaagagatgggggttggactctggaccacacagcactagctaaattaggtcccaggtagaagcaccttcccatgagacgcaccgcagtgccatgtcagtttaccattgccatggcaacgtccagaagttatcgcccctttccatgtcagtgacccagccatccagaagttaccaccattttccaataattttctgcataacctgccccttaatttgcatgtaattaaaacctggtttaaatacgacttcggagctgcctttgagccacaactctaggcgcacagcctgtgaggtagccttgctctgcaaggagcaggacctctgctgctgctatgcacagacacttcagtaaaagcagctaaccccaccagcttgcccttgaattcttccctgggcaaagccaagaaccctcccatcctaagccctgatttgggggctccctgccccgcaccacatctacattcttgctgacgtaatttcttggctcctcatagctggagacagagtcagcttccccatcccctcaaaccaggcagactctgagccttgctttggccaacggaattcgagaagtgccttgccccattcaagcctgggccttatgaggtcttccatgcctctgcctcattcacggcccaactgtaccctggccagaagccctgtcttgcctgatggaggaggggagagcaaggagcaaggcagtcaccccagcccaaccaaccaagaccctccagtggccacccaggtgcatgaagccccggctggaccggaggagctgttcagtccagtccggtcaagctgagaagctccatgcagccaatcagaggtttgggagcaatgatggactgtgaccgcttcaagccccaggcttcgggacggtttgttatgcagtcttattgggacgggggtaatacatacagttctacagttcttggaattctaccttggcctgtaagactctggccaatttattcccaatccgggtttcattttttacttccctgcccctccccattcactgtccggcccactttcttctccttggacatgtcaagcatccatacatcccaggccctctgcactccccctgcctggaatgctcctccctgaacactgacagggctgcttcctccctctgctcaacatgtaggtctagggaagcctcctggaccactcttttaaagtgccaccatcagcaggaactgatttcctcctcgtttacccaatttatttttctgcaaagcacttatcactgcctgacagtgtatcacacgcatttgactttttcttcatcgggcagttgaatgttgaggtctattttgctaactgctatacccctggtgcctgcaacagtgcctggtacatagtgctcaatcaatccttgtgaatgaatgaacagtcatgcaataagcagctcatggcccagggatgccacgtgtgtctcactatatagatccctgtttaggtgcaccgatgtacccctttcccttggtagggatggaggggacagggaaattccccaaaagacagggtggacttgcaggcggagtctagttagaccaccccacttggttcagactccagtgcttttccatctcttggtattttaaattccatagaccaggaatgaagggctccagaatactacattttctcttgtacaagtcccatcaaaaagaacacagctgggcatggtggctcatgcctgtaatcctagcactttgggaggccaaggtgaatggatcacttaaagtcaggagttcaaaaccagccaacatcgcaaaaccctgtctccactaaaaatacaaaaaaaaaaaatattatccgggtgtggtggtgtgtgtctgtaatcccagctactcgggaggctaaggcaggagaatctcttgaacccgggaagtggaggttgcagtgagttgagatcatgccactccactccagcctgggtgacagagtaagactccatctaaaaagaaaaaacaaaaaacaaaaaaaacaccaaagaactcttcttgagttcttcccatatatggggcaatccagccttagcgttcctccccaatcctccttgctaacgatgcaaaaaaggcttgaaaactccatatgccattaggctcttcttctccaaaggaagagacttggaaaaattgctcctccattgctatgaaaatgttcctgacaaccatttcttctgtatttttctgcatcctctaacataacattccgagtaagaaaaccatgtccagcacgccatgctttgttttgctggggaagcagtgagctcccttccccgaaggagtgagaattatgcaattgttcatattttcttttctgtccagcctccctggaaactcggagccaaatgagaatcttggagtaactatgttcagcctctgaggtggtatatcttagttctttcttctctttatgcaaacattccacttccttcatatcacttcattatatttaatgattttggtaattaggccatatgcttggaaagaagcataataaaaacacattcacagataatgaagtcatcaattatcattttttaagtaagaaaatcaggagggactcaaatcaggttaaatatcactgtgtgatccatgctgggagcaggggggggtgtctagtcagtttcagtattgttctcccatgattgttttaggaaacattcagccccaatttcagtcttttctatttcactgaaagcttttatatttggaaggaaaactacatcccgttcacaattcagtaaaacccagtggtgggtgtgatttggtggcccggtcaccaggctcttcaccaggctggcacttcagtgtctttgttctgtgcaggcaaaggggaggggctgtgagccggccctcaggcacacttagctgggaatcctgcaccccctgactcctcccaggatgggtctctgatcccagtagaatcctcttcagctctcagcaaatcaggttgattgaaactctgttgaggttccaattccactcacatcactgacaacaaaagaaaaaatgccaccaactcaaagggtgtgaggtcagaaaggagggaagatgctgcatcgccggctttgaaggtggagcgcgaggccctgagcagcccttgcagctggaaaggcaaggaatgaattctccccaaagctcagaaaggcacgcagtcctgccaacaccagatcgtagccctgtgaggctcatctcagacttctgacccccagaactgtaagagaatatgactacgtcgctttaagccaccgagacactgtgggatcacttgctacagcagcgataagaaacagacacacggtttctgagctcagtaccactgacacgtgggaccaggtgataatctgctgtaggagactgatctgcacggatctgcgcgtgggagagggttttacatccctggcctccccttccccagtcatatcaatcaaacgtgtcctcagacattgccaaatatcccctggagggcaagttggcctcactgagaaccatctttcatggctttttaatccaacagactctccgctaagctccttcctcccagggattcacggcacaccctccattaaattcactaagccctgaacctgtgtcccaggcactaaaggcagagggttggataagtcacggtgtgtgccctcagaaaactcacagtcatcgaggcagctgcttaaagaattatgtggtagcacctcctctcttgagggttacatcctgaaaacttagagcacacagtgagaagcaggatggtgagcttgctgagaaccgcaggaccagcttggttcacattcagggccggtagtcagagaatagggcatctttctttgctaatcgagatggcatcattcttttctaattgagatggaatccacatgccatgaaggtcaccattttagtgtgcagtgccccatggttttggcactttcacaaagttctgcagccatcattaccatctaactcaagaacattttcatcactccaaaaagaacctcataccccttagtggtcactcctcatccccatcccccccatcccccaccccctccactccccccaccaccatccctggaggggtcactcctcatccccaccccccaccccctccactccccccaccactatccctggaggggtcactcctcatccccaacccccactccctccactccccaccatcatccctggaggggtcactcatccccatcccccaccccctccactcccctcccactatccctggaggggtcactcctcgcccccatcccccacccactccgctccccccaccactatccctggaggggtcactcctcatccccaccccccaccccctccactccccccaccaccatccctggaggggtcactcctcatccccaccccccacccccagcacccccccatcatccctggcaactatccagaggctcccctcagagctccaaacgcttccccaaagaggctacagatggaggtaaaatcacttcttgatttaaagagtatttgcggatgcagcctaatcctgttttctgcaattgtgaaatgcaaatgaccctggtaatatatgtactggatcatagaactggagatgattatttttttatttttgtaaaaaaatgttttccagaatgataatccaatcaaattttaacacttggtgaaaaaattcattcagcttaactcagtggcatcaatagcaaatcaacccactggctaaatattgaaggagagctcagctcatcaggaatgcatgaggaacatccagttacctgtaccccctgatagagcaaggttctggtttagctatcctctttataacaaaggtcattaaacgtctgaggagcagcttaaaattcctgaagtttgaaacccactgtagccacctctggtctttaacgtaggcagactccatttccattcaggagcggtgtgcctgccactgcacagctcagctgtgtttaacatcctaaaaaatggaaatgcataattggctttacgggattgcttccagaaacactggaattttgttatttattgctttttataccacaaaaaggggaaaaacagccccaacatctctgaatgtggatgatggcttccaaaggagctttacataccttctgctcggggtcctgcagcccctccttcctcacaccgacctcacaaagagcagaagcggtcccaaatgcagaaagccagcttaccttcaggacctgttctaggttctccagcttggcttggagctggtgtttctccttcacggccaaatcgcgctctctggtcacgagggtgagcggatggttgagatgcacatactctgccttcacctgcaagcggaagggatggagacaaggaggttatcacaacatgcctaagagttggtatccgttgcttcctctttaggagcaaaatcttcaatttcctcctagagaatccttccctccctccttctccatcatggactgggtccactcctactaggggtcactacacatgaccaagggctggccaatcagcagacgacctccatcttcctccctcccacctccaccacagcctcagtgattggttcagggttgcaaatgtgtcacaggtctggccaatcagtgtaatctcatcccctggatgtggtgattggttggggaagtcacatgacccagttgcattctgggggaatgagatcttgcacttgtataggaacccggaagaactctcccttttgcccactggactcggaaagttaaagacaaacagctggaactactgtggcctttgccatcacgagggaagaacccatctgagaacagagccaatgagataaacacagagagatgcagagggaaaagcaggatccccatggcatcatttgagcacccaaatcaagctgagcctgaagctaattgtcttttccttttcagtcacttggaccaatagattctccttgtttgcttacaccaatttgaatcgtctgtcccctgtaactatgagagccctaacagatacaagtgttttcccactgtctaagcatatttattcttgtctaaaaattttatctcatcttaaaagtgaataaaaatgccaatgaaattccacatgaactagaatgcattcccccaataaacccaaaaaccacataaattccattctcaggccacaacccccagggccaagctacaagcttattgggaaggcaagcgccatgttcagtctctctcctcttcgaaacaagtaaggggatgctgtcaacgaaagaagtcaccatggttcctttcccattcattttcattgtggaggcaacatgttttaacccaacggcagccttgtaatttcttttcctcctcctcaagtgttatgatgtgaattatggcttcaataacagactaacataatgtcacgcttttcagctgcagaagtcctttctatttcaaatacattctgtactgagtgttagtttaacctgacaacttctggggcaccaaaagaaagggaggcacccacttggcattcccaaatgggaacagggttacaggaaagctgttattaagaggtcgtagagaggtctcattcgaaggaatattttaatgccattttgctgcaacgtgatgttatcaggcaacgaacttagagaaataatccaaatgcccccggagaaaatgtcacgacctatttgaattaaaccaccctcacttctgaacctcaataccctggggtgcaggtttgcagaaagcatcacttcttgcatcctagctgttcaagaacattaggacttgggggtcatgcttgaatgcccctaaattcagtctcacacggtgaccagcaccatctttctgaaatacctgccagatcttgcctctccctgcttgaaaccttctgtggtttccacagaaattagaataaaatccaaactccttggtggtctaaaagtcctacccacctgctaccctgttgccactatgctggggacaccctggcctccttctgtcccttaaacaggtcaagcttcttcccaccccggggcccctgcacctgctgattccattgcctgcagatctctacccggccctgccccagtctgctcaggtctggctccttctcattaggtgtcacctcagacaggccttcccaacccttgcaaggtgacgaaacccttgccttcaccccctgcctccatgcccctccctcccacaccaccatgctttggtgtccacgtgtgctcagcactgtcctctgcggctgtttgccttcttcctgtggctgctcctcattggaacagaagtgtcaccagacagaagttttcttctgccttgcaatttcccatcatcagcgcccagaggaccgcctggcagggagtcagtggtcgagcaagatttttgtactgaatggaatggtgttgaggaaatttccaagagtggaaaggtggccctggctcctgggtggactattgctgtcagccctcccagacacaggccccactgtcatcaatccccctttgtgtcctgagaggctcatcctcatggcctgcaccccccgtaccatccggcttctaatcaggcttgcccagtggaagacatgatcaagaaatgatggatcagcatgacccccggcccccggccctccccaccagcctgcagggattaccctgagctgctccccttagaaaggctgctggcgagcctggcccttggctggaggcctgggaagcaggatttggggagaattcctaccttccctaattgattagggcggcttaccacatctaggccacttgaacaggacagtttatgctgaacacctttccttctgggagtcggaatttcagtatgtgccggacagagagtgcccatgccaccaggtccccataaaaactctggctgctgaggctttaatgggcttccctgacagatgacatttcacacacatcacagcttgcagctgcaggtcctctaagcatcctgtgtgattcttgggaatcctcttgggagacgacctggagagcctgtacctggtctaccccggcttcattctgtgtgcctctccctttgccacctgtgctatgtgtccttttgctgtaataagtcacagccctaagggcagctgcacactgagccctgcgagtcctcccactgggtggtggaactggggtaacccccaacagtgtccttctacagggagggcctctcccacacccttctccctgtacccatagcaggtggccatggcccccggcctctgctggtctcagactcccaacctcctttgcaggtgtcctgcccatgccctctgcccccccgccccggcaacagcacccacacctttgttagtactttcttttctaaactctgctccatcctccagtttgcaagtgctgtgtatttgctattgtgaccctgatgggtaaaatctccaaaggaaaaaacattagcagcccagaagcaccatgatggctcagaggctccctacataaggagtttctagtttggggaggaatcgattcagattcgtgtttcacagagaagccaacttgggtttcaggctccatgtgcagaacccagcatgaagatgcatttattatccagctttttataagagcactggacagtcaggaattgccttctaagggtcagcatccagtgctttggtcaagaacagacaacctccaacctgcggacaggctgccgttccagtgtgaacctggaaagaaatcaccgggcaccggaacgcattctcccacaggtgtgttacaaacggcgccagaagctagagtccagctggcccctaaatcctatttgtcccacagtagagctagaagggagctaaatttaatacggtagagtggaaacactgtgtttctgcagtggacaatatggtggcaattgcagtgacttaaggcaataatgttgggggaacgaatgggtgtgttgacctcgaggtgatgctcataagcaaagtaaaaggaaagatcttggaggaaggtgaagagtccagacagagtccatggaggacctcggggcaagccaatgacatttactctttctttttttttgagatggagtctcgctctgtcacccaggctggagtgcagtgatgcaatctcggctcactgcaacctccacctcctgagttcaagggattctcatgcctcagcctcccaagtagctggggttacaggtgcacaccaccatgcctggctaatttttgcattttaaggagagacaaggttttgtcatgttggccaggctggtcttgaactcctgacctcaagtgatctgcccacttcggcctcccgaagtgctggaattacagatgtgaaccacctcacccggctgatatttactctttcatggacctcgtctcatgccacaattatggttttgcatttctttgacttaaaattccccatagtgtcatctttttgtttaccagaatgatgaaggccatggctctggttcgcaacaaggaggagagggtgtgtggacaaggagggggagggagaaccgaaaagactgatttcctggatgtataatggctgaataacggccccacacaaagatgtccacatccaaattcctaaagtctgtgaatatatcactttttgtggcagaacggaccctgaagatgggattgcatggagcatcctgagagtgggagagcaccggggttatccagatgggctctacgtagtcacagagcccttatcaggaaaagcagagtcagagacaaaaaagagagagcttaggtgatgctctgctgccagctttgaagatcagggaaggaagccaaaaaaaggcaagaggagagactgtcccccagagcctcaggaaagcacaccggcctgctgacatcttgactttaggactgaagacctccagagcggtgagacacggtggtgtgtgtgcttgtaggaatttgtcacagcagcaataggcaactgatgcggaaatcagctaaacagcagtcctcgttaccgcgagcacgcgtcgaattgtcactctacaccaacaactggcatctgtccctggaaagccctaagccccagtgagctgggtcccacccctccctattcccccaagtcaaggtttgtcacttcctctactggtacagcccccagggcttcagtcaccccagtggctcccctaaccctgcctgcacctccttaagaatgcttagcaaccctcaattgcttttggagtatgcgccatctctctcctgctgggaccagactgagaccgtctgtgacacggttctgatgagcctggagcagaaatctctagaggacaatgacctttcatgaaacagagcttcgtgagaaaagcttcagcccctcttcctcccaccacagtggggatgcgacccttcgagatggaataccacctgtctcggtgtcaaggaagccaccctccacacacgtctctgctggacaggagcccctgggccctggctccttctccaggcagctgcctctggccagggtcaccacctctgggcttcctgagcacaacagtgcccttcgtatgaaacccaccaagctcaggcttctgtgaggggcagctggaaataaccccagctgataaacctggagaagggggcgttctctaattcagcagccgctgatcccacctggatagaggactgatgccactaaattaaaacacgataaatattggctcccacgggccactcaaatgctggcgcctggggccggtagcccagaagacagcctggcagtttcttctctgcctggttgggctttgcagcccagctcgtgccagggagtcttggtggatgggtccttggttgacaaatgccctggcctctggctgagcacaatataggggtgctgggatccccgctgcatcaaggtctctgcctcaaagtccattgctttcttttttttttcttgagagagcctcactctgtcgcccaggctggagtgcagtggcatgatcttggctcactgcaaccttcacctcctgggttcaagtgatgattatgccttagcctcccaagtagctgggattacaggtgcactccaccatgcccagccaatttttgtatttttagtagagacagggtttctccatgttggccaggctggtgccaaactcctgacctcaggtgatccacccgccttggcctcccaaagtgctgggattacaggcgtgagccaccgcacccggcctgggtccctgtcccattgctcctggactagaacagtctcctggatgttctcaagggccaaatcagtctcctactaaaggagaaagtggactcagagtgacaaagatgactcagagattttcactaagacacacaaccaaagaaaaaacatcccagatgttccaggttaggagcccagacgattcttcctttgtcctgatgaaatgcaagatgaacaacagttccctcttatgcgattttttttagagaataatattcagctgcaaccctgggctggacactcacctttcagtcaaaaactaagcctcacgaatcccaaatgtctatgtgtgtcatccttttaaactttcataatttttttactaggaaaaaaaatgtttaaagagggaaattgctagtaagttgcatggttgccatctcataccagtgtttcctagctgtgcctatacttctacaaccttttgggtttctggccagcaggtaagaggattccctaggttgtaggaaattctgacccatgctacagcatgtgctcatgggtcatgaacttaatgacctactagtgcccagctccagaatgtcaggtactaacagggtttgagtgattctccaagacctgctcaccacacacaaacacaacagcacattagcaaccctgggcatcagatccagacactggactggattttattctctaaaaaaatctcataagagtgaactgttcttcacttagatccagacactggactcatttctgtttcaaaatagattcttgtggcagcaacggtggcaccaggtggaagagaagcttggaatatttggcatcagctactcaatgtgacgaaaaccttgaacctcagacctgctacaggaacagtggcccagtgcggggaggagggagctttaacaggcacctcctaacccaaacagagaagaaatttgaattatttttctgaaatcaacaaaaggttagttttgcagcttcaaaggcatcaagcatattctttgcactatgtcttggatcccagctcatcggtttcctcccacaaggctgcctgcctaagagaatccaattcaacactccagacagcccaacatcacagtttgcacctaagaaccaatcatttccgcacagggaaaaatgctgacactgcagtctctttgcattcataattaagagctctgagaattaatttccatctcttaatcagtgctactgaaaagcattttgcaattccaagcaagaatcagataggggaattgctgatccccaagtgtctccagggatccagaaggacactgttgtttctgcaggtttgcattgacaagcctacccatgagtctggagggacagttgaatacttccatcagcacaaagtcacccccacaccttcagcctccccagctaccacaaagatgctcagcccaagagacagtctctggggactgccactccctcaatgcctcccatgcaggtagccagcccaggcacttggaaggaaagccaagctccgcaaagcaggctgcaggacagatctggggtgcccctgctgcctctctcaaagcactgctattcctgtccatgccgggtgagctgctgggctccctcagacacccataagaagcagaagcaaaggccagctcatttcctgtgccttgcagccttgtttaaaaggccaagctgagaagacagcagggggagaaattcaaacctcaagcaaacaaacaaagtggtttgaatcctgcgggagcagggatgtcaagctgcactaccagccatccaggaaaggaggcctttgcctctgttgtgagggctgagcgctgggacccccacctccgccggcccttgctggcctggtcaatgcctgcagggctcagctccagcacccccatccccccacagctggcattgcctctccaggtgcaggagcccagctcaggagtggaacgtgtacacatgcagctattttagtcgtaggaagaaagccatcccaggatccgacctccctgtgcccagctccccaccagccctgtcgtcagcctgcgctggaggcctgaagcacccccatcttttttatatttttcctcctatttgaagaaaaatactcctgtcctaagaaagtcactaagccttatgatgcattcagacctcagtgtgagtgagtttagcagagcctttcctgcaagtgtaggtttggaaagtgggggctggtggaaaaatggggaaagcatactaattggagggtcaggatatattaagacactttttttttgagacagagtcttgctctgtcgcccaggctggagtgcagtggcgtgatctccgctcactgcaagctctgcctcccgggttcatgccattctcctgcctcagcctccagagtagctgggactacaggcaccggccaccacgcccggctaattttttgtatttttagtagagacggggtttcaccgtgttagccaggatggtctcaatctcctgacctcgtgatccgcccgcctcggcctcccaaagtgctgggattacaggagagagtcactgtgcccagcctaaaacacacctttttaagaaaaattatgataaaatacacattacataaaatttaccatcttaactattttacatgtaggtatttcagtggcattaaggacattcgcactgttttacaactgtcactaccacccatctctagaactctcttcctcttccccaactgaaactctgtcttcattaaacagcatctccctatcccccctctacccagcccctggcacctccattctactgtttgtctctatggctctgatgactctaggaacctcatataagtggaatcaaacagtgtttgccctttgggactggcttattcacttagcaaaatgtccccaaggttcatccatgcagtagcgtgtgtcagagtttccttccttttcaagggtcagtaatattccattggacacatatgtcacatgttgtttattcactcgtccatcagtggaaatgtgggttatttccaccttttggctactataaatttgtaacatgtacatatatctatttgagaccctccttttcaattttttttttcttgagactgagttttgctctgttgcccaggctggagtgcaatggcatgatctcggctcactgcaacctcaacctcccaggttcaagcgattctcctgcctcagcctcccaagtagctgggattccaggcgtgcaccaccacacctagctaatttttgtatttttagtagagatggggttttgccatgttagccaggctggtctccaacttctgacctcaggtgatccactcacctcagcctctcaaagggctgggattacaggtgtgagccaccacacgtgactgccttttcaattcttataccaggattgggattgctagatcatatgcaattttatttttaattttttgagcaaattccatactgttttctatagtggttgcaccattttacattcccagcaacaatgtgcaggattccagtttccctacatcctcatcaacacttgtaatttcctaaaaaacatacctttaaaaaatggccagacaggaaggcaagaaaataagtgtcaaatcaagacaactctaatttttatatttaatcactagagctcagttattccttgaaatatgcatgggcaaagctgcaaaattaacagcttaaaacaacccatcattcaatagatgttgactgagcacccgctatgcatcctttgaaggtacaggagagacagtcatggatgtaacagcaaagctctctgcaatcccaagcccacattctcgtaggagacagacaaacacataagtgaagacccgtgatagactaagatagcaagaaaagatacaaagaacatgaaaacaggtgttgtcacatagagaaaaaagggatggagggagggctgttagagtggacgttagagccacgaatccttaccaggagggacgcgtaacctgagggttgaaaggcaagaagctcccagctgttgaagatgatggagtggagtgttctaagcagagacaaccatcaaatgctgagacaagcttagggatccaaggaacaaaagtaagtcagaggtggacgagaggtagcaagatggacaggatggcagccacagggagaagcctcagttttatttatggaaggcattggaagggtcagaggattgcatgatccagagggcatcacaagatcactccagttgccatagggaaaagaccacaggatgacaagggagctagacaggccagttaggaaatggctttggcatctgggaaagagaagatgaccacagtggagaggagggggaggagagctggggcacgtctggtgctgagatgagtggttggtgcgctccatggtttgaatgcatcccccaaattccatgtgtgggaaacttaatcctcaacagggcagtactgagaggtggggcctttaagaggtgactgaatcatgagcactctgccctcatgaatggataggtccattcatggattaatggatcaatgtgttaatggaccagtgggttatcaggggagtggaactgctggcttaataagaagaggaagagagccctgagctggtatgtgagcacactcagtccccttgccgcggggcaccctataccaccttgggaccctacagagtcctcatcagcaagaaggtcctcaccagatgcagcccctcaaccttagattctcagcctccatagcttaagaaatagattccttttctttataaagtaccaagtttcaggtattctgttataagcaacagaaaacagacttgagcagggagttagattcggatgaagaaagagcagcgcccaggaggccccatcatggaggctcaggcaaccaggagtggccacaccattcactggggagaaagtggtttgggagagtgggcaccaatgggtttgttctgccttgctgttaaagatacaggtgcctaatagacttccaagcagagataaccagcagatagtggatgagacatcactgggtgcctcacgtgctggtcatgtgaagaagtgagagagacctggctcagcctctcaggccaccttcacactgatgttcagtgattcttccctgccccttcccagttgttcctccctggcccagcccgctccctccagggccccagatggtctgtggacagtggtatcagctaccttgtcatgctgccgggcccttgtgggaaggcctgcatgatgggatctcaggagatactctccctgggtggcatccttcagttcattttcctaggacaaaaggaaaggacatgtgagatggtgcccccatgtttagagacttggtagagtgcagtggttaggagctccaatgtggtaatgagacccaaggttgggcactgattctgcaatccataagctgtgtatgagttgggactgatttctctcttttttccaaaccataagtttccaaatctacaaaaggcaatcatgttatattatacgatgattagaatataatacaataatacatattaatcacttagtgtctgtgtcctaaaaaagcaacggaacttctcgccaattggagttgttaataagctttgacccatcctttttcccgtgaacactgctccaaacatacagccacaataaacaatagacagagaaagtttagaaatatttagccactcaaaaataagataaagcattctaaggactaaatggctagaccacaatgtggtgagcggaacttctggaaccttctagattcagagtccaaaaataggcagggagaattaagagtccagctttttcaagatatccaagattcaatgtattccacataagacaagagacatgaactaaggtcaccacatgacctgaggcaacagttaagcccccaaagaaagctgaaaataatccatcacctccacctagagccagagcttttatggggtcatgcacctagagaggcaagagggagaaaactcatttttaggctcagttttaggacttgtcttactctctactatcaccatggcacaggaactcggagctgccaataataaaatctaattcaagactgagatcacctagggtgtggtacagtaactacaaataagtaagacagggagagtgagcacagagatgggattaagaatctctcattcaagatgagtctgaaaagagaaattccagaacacataaagagaactaaccctactaaagagatctcataaacttaataatcaggataaatttactccagaggaaataaaaataataaagcaacctgaaaaggacttcaataagtttagaatcctaaaagaaggaatggcatccattccaaaaggaagagaagcagaagggataatcaatgactcacagtggaaggcagctggaaccacaccagctaccagctgtcaggctgagaacttctctttttcccaattgttcaagtttgttctctgttcacaccctaaataaattaatactggtgggacacccacatcttgaattgatctggttcatctctgttacaatatttcgagtgctcagagtctaggctccattcacacatcagaaaagcagcaagaaatcacgtggtttcaacacttcccactaggagagaggctcctcctggccattttcagcttccatttttcagtcaaccttccttttttcttagccacagtcataatgagctccgctactctgtggtagctacattttcacagcaataaaacacagcgaaggaacccaaacataaaagacggtggtgctttgttccgggaaacaatgattacccaaccttagggaaagtgattgataatggagcaattcccttctgtcttctgagatggtctggatggcataacatttattgttgcctttctcaagtaaagcagatcataatgtagtcccacactggttgcttgagagaactgcagcctcttcagcatgtcccacatgggggaatccctggaggtcttaaggggatgggatgggtgtactaatcaaaatacctggctgctgacctcagagaccaacatgccccaaggtaaactaaggcagcaatagctcagagaatttgagaacaagagacatttgaaataggggttagattatgggttctgaggtcaaattgcctaaatacaaatgggagctctccttaaatgtgaccttggacaagctgcctggcctctctgcactctctgtgacttaaggaggtaaaagctgcaaccctagcagatgttgtgaggattcaaggacatcaatctcacggaacacagagcacatcttactgcacagggtcaaggctcaaacaagtggccccttccctcctgaaggcattgcaatgactgcctgcctcttccacgttctgccaccacacagccacctggttcatgccatccgcctctctctgcatcgcatttaggaagagtgaattgcaagaaaggagcacagggaagataaacaaggctggtctttcacccaattttctggtggttatagaaatgcttacatctatttattttatttatattccatctcagtgattcaaggtcagttgcttatcctgatgaaatgaaatcagtcttttcaggaaaaaagctcaggatctaaatcctgtccaggaaacaccaacccatgatatcccaatgcaaagggagagaaacatcttcgtctctttccaatgtagcttcccaaattggtccaagcgtgaacaggcacttcagataccacttactatactgggcacaccctaccctaaaaaagccagtccagcactctggaaagccaaggagggcagatcacctgaggtcaggagttcaagaccagcctggtcatggtgaaaccccgcctctactaaaaacacacacacacacaaaaattagccaggcgtggtggtgggcacctgtaatcccagctactcaggaggctgaggcaggagaatcacttgaacccgggaggcagaggttgcagtgagctgagatcacgccattgtactccagcctgggcaacaagagtgaaactccatctcaaaaaaaaaaaaaaaaaaaaaagccagtcacagggagatctacttgaaactaacgaccccctacctcacacttcaagaatcacaaaaaacttagccaagtgccaaagcccttcctaccatgatggtaaaggaaacccattcagtgacacagacagccaggtaaaggcacaaagaaaacagcaaaggtaccagcttgagccttctcatactatgagactttatttgccagattatgagcatcccacgttgtccatgcttaccctgaagaagcccagaggtgggcatggggacgtgtggttccacaagcagctcagcagggaagccggcattggtccccactgtcccctgcagtggcaggcatggataccaccctgacatgcatgtgtttgcaggccttgggggggaaatcagaaaatgcctacctctcacccttctgatcctgtgaagatgctgaaaggcaagatggcttaacctggaaggcctcataactgaccctgtgtgctaccagagctgtccacacagggaggtggacactaccccaatcaaatcaagcctttctgaatcaatcagcaccactgaagaaattttgcaggaataccaagaaatgcagatcacctatgtgctggttgcacgcttgagatcagaaggcctccaaatgtgggcctggaatcgcaacacaacaaaacgagagtcccccagcagccggcaccagtggcactagccgtgacagttcccaggaggaggaagaggaggattgggggtgtggggggtctaatataatctgacactctgattaacaagcttttctacagcctagggggaggcaccagcacgtcagtcagatcacacaaacgcacgcgtggtcccacaccacaatgtaactgacacacttgctgggttcccccatagtggggctttgacgctgttgagtactgaccacatctgagtgctagtggtcgagtgtgatgcctcatgccccctgcctagtgacaggaagcccatgactcccacactgctgggaccctgacggggagaactttctgagctccagctgtaggcaccacccccgtcttagctttgtgacctgaaataacaattgtgaaaagagaaaacccagcttccagatatcttcttgcttcttcagaaatgtaatggctttttttccagggaaggacatgtaagcattgcaatggaatcgtttcagtctctaatcctttgaggttaaagccacacaaaagagggtttagggtttcccagccagtggatgccctcatgagacagagcctaccctgtaagaatcaaaacacacagtctgtggaatttaattgtctgcagccacaaaaaggaagggcacttccttacctccacttatgcccatcagagcattctgggattggatgtgaggactcctagggccacatgtccctgaaatccccctcccagggcagctacagaacgtgccagttaaggagatattttaatccattaatatccactaacacattaaacaggaatagccttatttgattttctagctgctgtgttgcaaaatcatgggcaaaaagtgaattctaatgaggatgagggaggaaggaaaagggccaaggcaagcctttcaaacgccactgcccacagggagagccgtgtaacacactcagtggacagggccagaggtgctagaggttcggggaacatggcaaccggccagcccaggccccagtcttagagggcagctgcgaccctgtccctcctgcgggtgccacgtggggacgggaactggccctgacagctgtctgtgtctttaggagctgggacactgggtttccatccaaaacatccctgtttggatatggtggctactaactcaaaacacacataccatgggctccttcccaaaatagacacatctacaggcggaattcgacttcaaggcggggcgctgcgtaaaagcagctggacttgtgcagagtccaagtgcaggtggggtgaggggaggtgcagggagccccagggaggcacggacttcctgtgcgcagggagaggaggaggaggtgggtttccacggaggatggcccacagtgcctgaggctgtctccctgcctgctgtggactgaattgcatctccccaaattcgtactttgaagccctagcccccagggtgactctatttggagatgggactcttaggaggtaaggaaggttacatgaggtcatgagatcctaatccaacagggaccggggctttctaagaggaggacgatctcggtctcgctgcctgcctctctttccccctctctctcagtctcactctgcctcggttttagtttttctttctgcctctatgtctatctctctgttcatttttctggctctgtctctatgtctctctgcctctctgtctctgtctccacgtctctgtttctctgcttcttctgtctctcccagtctcactctgcctctctctctctctctgcctccatgtctgtctgtgtctctgtttctctgcctctctgtctctatttctctgtgttggggggggtttctctgcctccatctctctctgtcccctacccactacctggccgtgtgaggacacagtgagaaaacagccatctgcaagtcaagaagcggctcgcaccaggaaccgaatcagccagcaccttggtcttagacttccagcctccaggactgagagagaggagagctctgtcatttaagctgcccggtctgtgggatcctgctatggcagcctgagctagtgtatagcctctgctaaagcaacgagacatggacaggagccttcacagtgtctcccgaggcagctcaagggctcgtcaaggaagaaactgggtcttctgaagacacccccttccccatcaggagctccagttaaatccccatttcaatggacaaggtggccgcttctctgggggagaaactgacaagagaaaggaaaaagcacgttctttcaataaacttgtcaattttattcatttcaataatccctccaccaccaccactgagtgtgtatgtgtcagtaccgggctcagcagggggccctgagtgagtgggtgaggagcaccctctgcccccagccttgtgggtgcagcagacagcgcagggcattctgggttgagatgtcaggaacgccagttgctatggggagaggtgagaggaattctcggtatctcctgatacaggtctggtctcagaggtggggaagagggtccacccagcacaaatacataacaaaggcatgtaagggcacagcaaggtctctggctctcaggatctggtatccacgctacaggattcaaaaccatgaacatccaatctcctggccacactggacaggccccagcaagatgcttcctcgcagcctctgctctgctggcctcaaagaggttgcctccagatgccggggtggtgctcccagccctggagatggacactgctcctgagtagggcaggatttggacacgggaagctcctcagtgagagtggacatggtaattaacccaccacgtctttctgatcacatgaatgcaattaattcttgtgtaaatgagatgcaacctcccaagagtacagaagcttcttctctgctcttctttgtcctctacctgtggttccagaggcatgagccaggccagattcccagtggcctcaagcagagccgagccaggccagattcccggtggcctcaagcagagcccagccaggctgcagtgagcaggggatacacctcatgagtgaccagccccatgcacagacccacagtggagaggacacaccacatgcagagagctacagacagctgggctctggctggacaggcactgggggtagcagacgtgaagaggcaagaagggttgggtggcgaggacttcatgaacctcactgaggagtttgtactttatttagaatgaaatgcagaagctgtcaaaggtgtttaagtgaaataatagaaaaataatatctgcacttgggaaatactgtcctgggtgttaaggggattgaagaagggtcaggctggagtcaaagagaccaatttgcactcatttaggggacaagtgccagtggccagaattgagattatggcagcagaaagcagaaagaggaaggcgggtacaggagttattaaagcaagtgaaatagcatggcttggtgacgagaaaagaaggtgccacattctggcttggggctgcagaggcagggaggagggagaaagtgcaggtttaagggatggggcacgttcggttgcgctggggcttggtgagtgtgagaccccacgtgaggcccggtgggaatgctcaggggacaggtccccacatggcccagagctcaggaaggagagcctgacccagacccagatgtgaaagttgcactgataccgacaccactttgagtcacaggaggggaggagctctcagcaagattaaggagcaggagacagagctgggagaagcccaagcatcacaaatgggcatgagccgttcctgtagagtgcagggcagaagcaatgggaagccagctccaggcttttctaggagctgagtgaccagagccttgagagtggggaccggcaggtcagctactgcccagaagccaagcagcattgcgggcatctccgtgacctccaggagaggctctggtgatgggataagcagagggcagcatcaatgggtgggagataaagaggaagagggaggagatgcttttttgcagagtgctgggtgagaagaggcgcagagagacaaggtcatgcttagagcctcctaggggcatggatgactaaggaaggtagagaatgccctggaggcagtcacagagtcagtaactcctccttcctcccacaggcgagtggaatgtgggtagctgccgggaacagcagccctccaggaagcccagtcaaggctgagggtggtaacgttcatgggggcattggcaggtgcagatggacacatggggaaggcatgagggcagcagagagaaggacggggcacttggggatgagatcgtatggggggagatgacccaaggggctcatgttggatgatgcagcagctttgatcccctgggcttctacgctgggccaagaaccaacataagctctttgctttcctcctcttctttgtgaaatctcatccagtcctctcagcactgccatgtggcagacattcttgctatcctgcttgtcaagggaagaaattcaagctcaaggaggttaagtaactgagcgagcagcctcccccgagcatgtggaggggtgggactcaagcccgggctgtgcagctgtcaggtttgagaccccctcctccctgccccaatttgcctcttattctcctgaggaagagcatcatccagccactcccttggtcccaaggcccagaggaaggttcagaaatgcctccagttggcaggggtggggggttctggaaagcctggggtatcttcccttgcactagagactacagatacagtcttgggggcctacaaaaatatttcctggtatttttagttccatgaaatctaaaagaatatataaaggaacaattttgtaccctattcaggacgaaagccaacatctacatttgggtttgtgggccctcctgtgccggcctgaagaatcaccgtattgactgtcctgagatgctgaaagacaatgaaaggtaactccaatggtgcttttgtgctcgatgaaagccagatgacttctacaggctcaggcatcaaagatcttgcaagagtttgaaagagatcagtggtaggaattgagtcaacttccagccaactgtacaaaggcattaactttacttataagaggaaatgtgatttaagttaaatatcatatgacacattaagtcacagcgagtttgggttttgaattttattggtgtcttaaagttgtttctctttgatctgctcattcattttggccttatgttttagaaaagccataaaaattttataaccagttttatctctggacacatgtaattacattatgaattataaatatataaccatattatgctcaaacatagactatatagttataatatacaagtctggtagaataatattatataagaatgatgtaattatcaattataataacgtaaaataaaaataatctaagtcaacactggagtgtgcttggtaatattttttctttctgaaaaggcttcataagtggttctagcctaaaggcatgggtgggagagtaaagtgaaggaagggaagggaagaaaagccgctggtgggaagcctggagagggagcctgaactaaggagagaaggagaaaccacagggtggaaggcgagtggttgctgctgtccagggtcctgatggtcactgagccctactcccgcccgccccttgaggttaaggccgagggcagtcagctaagtcatcccagggtgtggagggaccgttgggacttggaggacctgggtttgaagcctatcctaacactgaccagatgtaatttggggaaaattattaagcctaagtattcttggcaatttaaatgagataattcatataaatgtattcttcaagtcgtaaaggacaatttgaatgtgaaatactatgctaataaagggactggcactaaaacaattgcttctggtttcccagtgtcgggggagggttctgggggaggctggagagagcaactccaaacttctcagttcccttctattttcagaaatttgcttcaaccatgactgatacatgctattcctgatctgtttgatatttcagcattgcacatatgccaataatgcaattgcagggaagcacatggtgctatttaaaaactgtgttcctaacacaagttagagacaagctcaagtggaaaaatataatacatgaagcagattctcaggtgagtttatgacatttacattcaccttttaaataaggcttctctcagcttctgcacagcaaaagaaactatcatcagagcaaacagacaacctgcagaatgggaggaaatttttgcaatctatccatttgacacgagtctgatatccagaatctacaaggaacttaaacagacttacaagagaaaaaaaaaaaaacattaaaaagtgggcaaagaacatgaacagaaacttctcaaaagaagacatttatgtggccaacaaacatatgcaaaaaagctcaacatcactgatcattacag

SEQ ID NO: 349 - DNA, 66974 bp, Homo sapiens
tttgtttatttgaagtaaaatcactttagccaactaccataaatattggctgcctgtcagaaatgatgtacccgaatttcacgtttttcatttcctcatggtaacccagcccacacaatatttttatataatgacagctgtcaggaaagcagaatatcttatatatacattgtattttgattaatgagctaatgatggttctctgtttaaagtaattagcccccaatgtggtttttagccaaagtgtgctcagagttgacaatgatgtgattatgttatccagttagggtatagccaaaatgatcacattgcctatagcaatgctttttgaagtgccattactaggttataaaatcaacttaatatattttattagggttgaataaagaaaagaaacctaatagattagaatataccaaagatattagcataccttgagtacaacatgtgtaggtttatgaaacctttgttttaataatgtgtgtatcttttgtgtgactgcaaagtcatcctataaaatgtatttctgaccgtggattacagtaaaaacatttttagaaaccctaggcttctttcaggtttttattgcaactgaagttgttctagctttggcccttggctgtgtaatgattgaagtcattcccttatacacacttatgctttcttaccaccccttggccagccctttggtggagcccatttcatccctgccaatggcatgtgaggtcctcacttctccagctttacctcttactgccctttccctcttgttcagtccatagccttctttgctgtccttgaacgtgccgtgcaggctgcagctgcagtgcctttccactgtctgttccctctgcctggaacactcttcactctggtattcacacgcctacctccttttcttccttcaagtctttgctcaaatgttagctcctttatgaagcccactgtgaccacgttatttaaaatagcaaccctcctcttttttctcacagacctcctttttctgctatatttctttcctccacagcaccagccaccttctatcacattgtagaatgtatttattatgtgtattgtttgtctgtctccctctactagacataaagtccaggagggtaggtattttagtatgttttatttatggatttaattcaagcaactagaacagtgtctggcacaaagtaggtatcaataaatattgatgagctaattcagattggtccagatcatgagagagagagaaaaagagagtggccaagcatcagatacaaatttacaggagattctagtgcattcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgattcgcccgcctcggcctcccaaagtgctgggattacaggcgtgagccaccgcgcccggcctctagtgcattcttaagttatgtcctgtcttttatgagaaacttctaactctcctttgaagtagctattctttttacattttctccttatagggcccattcccatctggctctacaagatattagagcaacagcttctactaacttctaggaattcatccagaagagtgtattgaaagtcaaaaaaaaaaaggagtctctgtttacaatttatagtcttaatataactaatctaggcaaaatcatcaaaacatgtgcttctgctgaacttatttatccaacatggaaaataaaatagtaaaaaaaggtcagaaaataaatcttggggatagttggtttacaacataaaactaaggaagaaaagtaacaggatcagtgcaatgggcccagtttcccccgcccctgctggagttaccacatttagtgaataaactaaactgtggagttggctctgctgctgaggcaggagtgttatgtacttgggccatctcattcatttcccgcctgaaaatttccaacatagccagaaagacaggctgctacttgcacctaatgaagtcaacaatgcctttgtgtactgactccaaaaatgatagcttgatctggacattgttatatgaagcatatgtaaagtagcttctgttttgcaagagttagattattattaaataaatcatttctggaaaaaatggtagaaagtcacttctgagttgtacatggttaccacaggaatgtcatttggatgtttgctcactgaagacacacctgatgttagaaataagaaacggaggcaacttcaaatacattgacatcataaaatagcaagcaagcaaacaaaaaatgcacaaaagctcagcaaggggtgtctaaagatttggccactccttttaatcattgtcctaacctctgttatttatttaaaatactgttcagattatgtaaaaagcaaaaaaagtattttttttcttctatccccaaatttttaccttctttgtcccaatctatacttatggtctgagcaatgtgaacatcaattcagctataaagctccttttaactcagtgtttaactctgaaaccagaaatgttgcaccatagcttgttcatacttcttaatcttttaaatcttaatccacattttaagtagatagcaatatgtctggagagtgcccatccacaagaaggtgacagagtctatttcgttataggcgtgccacttttttgtcaatttagtcacaatttaatcaattactgccattactatggaaattactacagaatgaatattgtagtctttaagtacagagcaatccttttacattttaactcaatattaaatcctttttaaatctctagtttcttcccaaatccagaacaaaggatgcttgctttgttacaatcttcacctctagtataatcttaataagaaatacaaaagactcatttactctgcctaaaagttttgataaaggtattttttggaatgtgctgcatgtttatgctaaaaatagagaaattataagcacttttaaaggataatctgtttattaattgaattatattatcaaagaattagagatatttagtgaacaaatgaagaagactaagttttcagaaatgttgcttttgcatgatcaatataattgcaaaagtcaacatgaaattgacattattctgtggaagttacaacactttctctttaaatactcagtcaatattacctatttttgctcttaagcaaaacattgggtgaaatgctcacattaccagaaaaatttgttaatctttggcaagcaacaaaccatgtttagtacttgcatttcctgttttacagatgttttgttagactgaattaataaaatatcttattactatttgaagagtattttacttatagtgagaaagcagcagatatgaacagctttgattttagtaatgtgtctccttaagcctcttaattgtagagactgttggtaaaagtaattaagatttaccaaaagagaatcaggatatcattgtttaggcacctaagaggaagaacagggtaaaatgaagccagaaattaatagtatttccaccatcaaattaaaaatactaaaaattttagaaaatatatcacagttgaagtgattcaagtgcaactatggttagactttagtaaccacccttttattcttattattctttttaactgtgatcatattttctataaaagtttatatcctgcttcaaaaaacaattttttaaaattttggtttccccatttattatcatgttaaaaaatgcatagcttgaaaaaaatctcaaacacactgcattgtagaaaatattaatagcatatgtaaaagcaaattaggtgatgataactaggacatcaagttattaagattatatgaattgtgtgatggttgctagggtgccaggcagcaaaatgtgtaattatctgattatctgatttatttaattctggcagtctatctctacagatacttcagccagaaaagtatactttggagcttgaattacctgaatttctagctaccttgattttatataaatatatgtaacacttataactatatacacacacatacacatatggaaatgtgtaaacatagcaccaatactcttcagccaaggaagccaggaagtcacctgtagttgaacaagtttggttcattacttgttgcagcaaggaagaacacacatcacggaaatcatgggtgtttcagtaagagggtgttagaaaggaccttataggatttgggctttgattgagtgatttgaggtagagtctaaggcagcggggattccctctagattggatgctgttagaaagtggagcacttctgtaatgggagatctcacttactcttataggaaggggaaactatagtgagaataaagttgtcattggtaaagaaggagcactcattttggccaagagataggatgtttggtacttcatgggtggcaaagtgacttgcttttgtctgtgctcacacaaaattatgaatggtcttatttaatcatggtctcaaagtagcccggtcagaggctggttttctgtgagatggttcatgtctaatgggagaatcgcagggtctgcctatgagagccaggccagcttctgggtgtcaggtgctgccctttttccttcctcaatagcttcagtcattcttatgctacgatgggcagatctcacaagtttatgtgtgcctttttttcacactgccaagtacagttcagttttaggttgggttggttacgagagaacagaaagggaatattcttcccagaaagaatgattcagtgctactcatactcactggtcccctttctacatagttgatgctctcgagagcggacttttctcccaatctgatgcttcaggatgatggtgctttctctattgtcactcaatgagcatttgatggcaggaaaatttggtagaagagaacaactttttctcctgagaaaaatgatgataaacatggattttaattttaattttgttttgaaagaagcaatcttacagatttttaataatatagaggagaaaatattcttccactacctttaatacaatgtctgtctgctctaattaccactaagcattgctgaaggttatttggcactgaattcttctcccgtgccccacccagttttttttttcttttttctctttttactaaaaaccaaacatctattgtttccagcatttagaagagtctcaaattttctactcaagaggtgttaagttgctgctcccttcttattctttgtacagaactagtacagactagtactgcaagtaattcacagactgttttatgatatactagatgtaatcaatttgttttgatttataaaattgggaataccacaagccacgacagcttagctatccgcataaatatttactcaaaaaatatttgctgagcacatgctatgtttccatattattttgtcccaggcatggggacaccagggagggaaggaaggtgaagagcccagtctctggagtcctaaggcctgggttggaattcctgctcagccacttgctagtcatgtcatcataggcaggtacttgatctctctcgactctacattcttcctctgtaaaatgtgggtgactaaataatacttacccttaatgctgtgggagggctgaaagaggtcattcgagttaactgcttagtgcagtgctcagcatagttaatactcagtgaagccattgttattttttgacaagatagtggtgaattactagatgctattcttccctcaaggaactgactggttcctctcactggtgaaattggaggcatctcacttattcttgggaagagtattaggaggcaggaagagaaggcacttagtaagacctgatggatgagtgagagttgtcctggcagtggtaaagggtaagggagaagggaaggaatgatgcttgtggagaacaggatggtctcagcattggggacacaataccaagtgctagatgtgacagagaagagaaccacaggcagttccttgtggccacactgtggactgggtggagagcgacataggtggtgggaactgtagctggggagtccagccaggaccggatctcaagggccatgtgttcaaagcttagcaccttagactttaccttgaagacaacagggatctggagtcagcctatcagtaatggtatccttttcaaaaaggtacttacataattttttttaatgataaaggaaattatttacagaaagggcagagttcattgttttctcattcacagagtatagcaaccgttacccgtacgagcctgggcctctcatttaatttctcctgcccctcattccttacccatgctttctcccattcctctccatattaaagacacccatattttatttaagtcccagagtatatgtgcaggatgtgcaggtttgttccataggtaaacgtgtgccatggcagtttgcttcacctatcaccccatcacctaagcattaaactcagtatgcattagctcttttctctaatgatctcctccccgaccaccctccgcttacaggccccagtgtgtgttgttcccctccctgtgtccatgtgttctcattgttcagctcccacttataagttagaacatgcggtgtttggttttctgcgtctgcattcgtttgctgaggataatgacctccagcttcatccatgtctctgcaaagtacatgatctcattcctttttatggctgcatggtattctgtggtgtatgtgtacattttctttatccagtctatcatcgatgggcatttgggttgattccatgtctttgctattgtgaatagtgctgcaatgaacatacacatgcatgtatctttataataaaatgatttatattcctttaggtatatacccagtaatgggatcgctgagtcaaatggtatttccagctctaaatctttgaggaatcaccacactgtcttccacaatggttgaactaatttacattcccaccaacagtgtaaaagagttcctatttctccccagtcttgccagtatctgttgtttctttttttttttttttttttttgagacggagttttgctctcgttgcccaggctggagtgcaatagcgcgatcttggctcactgcaacctctgcctcccaggttcaagcaattctcctgcctcagcctcccgagtagctgggattacagacacgcaccaacacgcctggctaatattttttgtatttttagtagagatggggtttctccatgttggtcaggctggtcttgaactcctgacctcaggtgatccgcccacctcggcctcccaaagtgctgggattacaggcgtgatccaccgtgcccggcctcatctgttgtttcttgactttttaataaccaccattttgactgccatgagatggtatatcattgtggttttgatttccatttctctaatgatcagtgatgttgaacttttttcatatgtttgttggccacatgtatgtaaagacacccatttctttatgtgcttgacatggccttaaatatgcatgtatccttgtaaattacatcgtgttgttctttgtgccttttaaatttacctacatggtattctgctaaaaataatttcctgcatctaaatttttttctttagatacaaagcatctgtttgtatatgtacaccaatcactgtgtcaaactgctgtatacatagcccatatacaatacacatggtagcattatttataataacagtttgaaataacctaaatactgcacactagggaatggataactaaccctagtacaccagctgtgttaaatatcatgccttcattaacaatgatacttctcgatatgaaggggcacatgcttatgacaatgttaagtgagaaaagcagacaaaacagtctaaattgtgacaacaaccacaaaaatatacattaatacagccaagggctagaaaggatcagagaaaaatgaaacaggtatgtatgtctgagcaagggaatcatgggtaacatttctcatgtacagtagctccccctattcgaagtttcgctttccaaggtgtcagttacccccagtcgaacttggtccaaaaatattacacgaaaaattccagaaacaattcgtaagttttaaattgtacagtgttctgagtggtgtgaagaaatcttgcaccatccagcttcgtcctgcaaaggacctgaattctacctttgtccagcggatccacactgcagaaggtcccctccttatgagtcacttagtagctgcaagagtagtgatgctggcatactgtgagaattgttctattttattattattgttgttcatctcttactgggcctaattttcaaattaaactttatcacagatatacatgcaaaggaaaaaacagtatattagggtttggtactatttgcggttttaggccttcactgggggttttggatcccatcctacaggaataatggggtgctcctgtagctgttagtaagacgatggtgtgcctggggatttgtgctatacaccacagcatcttctacagtcgttttgggggagagggaagatcagagcagtaccaatctgctgctccttgccccaaaactggcaagaggcgcctttcctcagccagaaaggcctcttctccaccagctgtgtcctgcaatcaactgcagctgtattggtctcaccccatgggaaacaggtttgaagttaaaaaccttttcagagggccgagataaatttagtgctgctaaatttaactatcttcaagattaaacatgaaaagcaaagtgcatgagttatgtatattattctttcaattgtgcaaaaataagacattaacttgtttttgcatggaaaaattctgcaagaatagagaagaaatgttaacagttacccctgggatctgggataaaagagatacatcatgcttttctttaaaaaaaaaaaaaataggtttttgtggatttttttgtttttgttttttttgacagagtccagctctgtagcccaggccagagtgcagtggtgggatctcggttcactgcaacctccatctcctgggttcaagtgattcttgtgcctcagcctccgtagtagctgggattacagatgtgcaccaccacacccagctaatttttgtattttcagtagagacggagtttcaccttgttggtcaggctggtctccagctcctgacctcaggcgatccgcccgcctcggcctcccaaagtgctgggattacaggcctgagccactgcgcctggcccgtgcttttctctaaagtatgaaaggaatatgtactttcttcttaaaaaccatgtaccaaacaacacttttcaattaaaatgttatttttaaaagtttaaatccccaaatttcatggctctaactttttaaacatcactttttaaataaatgtctaagtttttaactcagtatacagcgttctccaaaacaacaaattcatattctgagcccaaaactgtgcacctcttttagtgatgaggacggagtccaaattgaggacatcccttgtagctcacaatgcacacatattctcacatcaatagcaacacagaatgcaactgatgaccaatatatattcacaaataattgaggaccatggctaagagttgcattcggattccgatgtgactgctattgtccttaacacggactagctccaggtgagtcccccggccccgggggtgtggcgggcgtcacccgttgtccgggcacacaccccgcagacccaatcctagcccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgttagagtgtatgactgctttttaatgcaactttgcattcagtaggtttagtaataatattttcaatatactgagagaaactggattacaaaactgtgaggtaaattgttactttaaaaaggctttagtttttggtaaattttttttttttttttttgacacggagtctcgctgtcacccaggctggagtgcagtggcgcgatctcggctcactttttagaaaatagagaaaataataagaacttcaatctcccatttcttcattacccagagataatgtattgtcttataataatttttagaaaggaattacagttactttgtaaccttttttttttttcaacttttattttagactcagggggtacatatgcaggtttgttacagaaggatactgtgtgatgctgaggtttgggatgtaattgaacctgtcacccaggtagtgagcatagtacccaatgggtaatttttcaagccttgctctcccactcttcctccccttgaagtccccagtgtctattattgccatctttaagtccatttgtacccaatgtttagctcttacttataagtgagaacatgtggtatttggttttctggtttttttgcattaattcgctcaggataatggcctccagctgcatccattttgctgcaaaggacatgatttcattctcttttatggctgtgtagtattccatggtgtatatatgccatgttttctttatccattccactgttgatgggctcctgggttgatcccatatctttgctattgtaaggagtgctgtgatgaacatacaggtgcatgtatctttttggtagaataatttattttcctttgagtacatagccaatagtggccaatagtgggatttctggatcgaatggtagttctgtttttagttctttgagaattcttcaaactgctttccatagtggctgaactaatttacattctcaccaaaagtgttcccttttctctgcagccctgccaacatcatctgttatttttttacttttaaataatacctgctctgactggtaggagatggtatctcattgtggttttcatttgctttgctctgatgattagtgatgatgggcgttttttaatatgtttgtgatcacttgtatgtcttcttttgagaagtgtctgtttatgtcttttgcctaccttttaatggggttatttgtatcttattgatttgtgtaagttccttatagattctggatgttagtcttttgtcagttgcatagtttctctcactctaggttgtctgtttactctgttgatactttattttgctgtgcagaagctctttagtttaataaggcccccacttgtcaatttttatttttgttgcaattgcttttgagcacttagtcataaattgtttgccaaggctgatgttgagaagggtatttcctaggttttcttctaggatttttatagcttgaggtcttacagttaattctttaatccatctttagttaatttttgtatatggtgataggtaggagtccagttttattcctctgcatatggctggtcagttatcccagcatcatttattgaacagggagtcctttccccattgcttatttttgttgactttgttggagatcagatagctataggtgtgtggctttatttctgggttctctattctctttctttggcctatgtgtctgtttttgtatcagtactatattgtcttgattactgtagccttgtagtatagtttgcagttgggtaatgtgatacctctggctttgttctttttgcttaggattgctttggctatccaagcttttttttggttccatatgaattttagaatagttattttctaattctgtgaaaaatcacagtagttacctttttataaacattattttgttactattttcccagactactaactgttcttcataaatatgttttttaatgacagtataatttttgattatttggatatttgattatttaataaccatgatcctgtttggacatttggattattcacaaatgttcactatttgaagaatcagattataagtaaatatttgtccacatattttattgtttccttataatggatttttggatgtgggcttattggattttcaaatatatatttatgggaatatatttcatggaaagtttataagcttttgcactctaggcttattttaatggtcttgcactctaacaaacagtgggtgtgaaagcttaatgccaccttgttagcattggttgttacctttggaaataagtgtaaaaacattttattgtggttttaattcatatttccctgattagtagtgattttgaacattttttcatacttactaatcaattgtcatcttatagagaattgtcttttatattctttgctaaattattagagtatcaatatttttcttattgactaaaagtattctataacttaaggacattaattatttctactgtgtttgttgtaaatttcctttcttggtttatactttgcctttaattttgcctatgatttttgacatgcaggtgtttttagtttttatgtagacatatatacataaacttttcctttacacagatattgtacttagaaagatatttcattttacaggaaatttaaccagacacttttattttcttctgatttttttaatagttatgtttttggttcttttttgttttttttttagatggagtttcgctcttgttgcccaggctggagtacaatggcgtgatctcagctcaccacaacctccgccttcagggttcaagtgattctcctgcctcagcctcccgagtagctgagattacaggcatgtgccaccacgcccagctaattttgtatttttagtagagacggggtttctccatgttggtcaggctagtcttgaactcccaacctcaggtgatccatccgccttggcctcccaaagtgctgggattacaggcgtgagccaccacgcctggcctatttttgttttatatttaattacttaaatcatctagagaatgtgtaattatgtttaaatatgctgtgaggtaaagctgtaatttaattattttctcaccagtttagtttttcatttaatctgtaggattattttgtcaagttctaagagtaagttccaatgggatttttactgagattttgttagatgcataacttactttgggaaaacaaacatctttacaaacttaaatattcttatttgggaatatagtatttctttttagttactcaagtcttaagaatacctttcactaatgttcggttcttcatcttcaataggttctagacatatctttgtatgagtatgtgtagatattttcattgctattaatgaaatctgtttttttccagctaggtctaccaactggtcattttgtggtaaagttttatatttttatatatttatcttttaaataaccagtttactaaactattaatggaaaaattttccattttatttattttgggttttagtacataatatagtatgtaatttagtttttaaaaattgcatgcaattctttctaatagttacacctcttttattatatattttacattatattacatgggctagaatatccagaacagtattaaagagtaataatagccgtctttgtctaattggtgattttattgatgtgctttaccattaattctgacactagctgttgctaatatgataaagactatccatccttttatacttagtttccttaaggtttaaattaataattggtgttggttgttatcagaaagctttttggcatctattgaggtgtctataaagtttttactacttactatcaaactgtacccaaatgtctaataaactcaccctggcagtagataaaggatcaatagcataatggatacatcctatctttcttaacctttgtcaaatatagttttcaattagactttctacacttttattaaggaattttgcagacatattcataagcaatgctgctgttaggctttagcgttagaattaggctagctttccattttttccaatgttctggaaggattcattttgcattattatattctattgctggaaaatgtttaagaatcttagaggtaaaactatctagcactggagcctttttgttgttatagttttctttaatctgcaagagtttctcatctgttctttgtcttacttgacatttttgagtacagggtaaatatttgctggaatatttcttattctaatatttctttttgattaaattcaagtcatactcttagggcacctccaggagtaatatgtctttctcagtacaccatggcaggaatcacagtctatcccaatatcagtgttgttgactttgatcacttgattaaggtgctgcctacagttttcattgtgaattattgttgattatttttataattaataagtaatttgtgggtaagtattctgggactttgtaagtatcctatttcttatcggatgtttgcccactatttttaggatctgatgattttctaactttcatttcttctatatttatcagttggcattcttctgtaaggaagaactttcccttttccttgcttcttccctcatttatgaattcttaacagtatggatttatagatttttattttatccagtgggctatattgcattattattattaattttaatgctcatgttgtttcagaagagctagtgggagacccttcaagctgacttgtgtatcttttgggtatgtttctatcattctttaatacattcctgcttctgcgactggagtttcagcctcttgtcctgtgcaagccctgaatccacctttttttcaaagaaccctggttcctttcagtgaagaatggtatttagaaaccaagatctaggcagtaggtatgctcattgctattggtatgtcattgcttaggagccaaagctaggaaatgtgtgtgtgtgtacaacatgtacacacacatatatacactatatactcgtatcaacatttctaaatctatccatgtatctatcagtatttatctatgtgtgtggttttttgtagattccctttatcaggctgagaaagtttccttctgttcctagttcactgagagtttttatcatatataggtatttatcatatgtggatattgtcaaataatttgtatctactgagatgatcaagtagttttctttttaatagaggaatgtcttttaatatatgaattataatgattgatttttgaatgttaaactaattttgcattcttgagataatccctacttggtcacagtatattattctttttatatgtagtatggggtttttttcctaatattttgttaagtacttttttgtatctctgttcatgagggatattggtctgtggttttctttacttgtaatgattttgtctgattttgatgtcagagtaaaactgggcttataaaatgagttgggaagtattctttcatcacttattttctgaaagagtttgtgtgaggttggtgttgttgcttccttatatgtcggacacaattcaccagtgaagccatttggacctggaattttctttgggggaaacttttaaattactaattcaatttctataatagatgaagagctattctaattttctttttttttcttgtgccagttttggtaatttatgtctttcaagaaatgtatccatttgatctaggttgtcaaatttattggcataagttgttcatcacatttttattatccttttaatgtctgtggatctgtagtgatattccctttttcatacctgatgttggtcatctgtgtcttctttttgctttctctgttagtatagctaaaggtttgtcaatttcattgatcctttcaaagaatcattgtcttctggcttgcataatctctgatgagacatctatgatatttcttatatttcttctcctttacataatgtgtctcctcctcatgggttcttttaagattttcttctttattactagttttcagcaagttgactatgatgtgttgatgtggttttctttttgtttatctcatttgggagtgtattaagctccttgaacttttgagtttttaattttcatcaaatatggaaaatttctggccaatatttctttaaatacctttttccattctttcctcccttttctccctatcccctcagcttctggcctccaatttcatgtatgctggaacacttggtattgtcctccaggtcctatcactgagtttctgttttgttggttgtttgtttttttatgttccatttttagacagtttctaggtgtatcttcaagtttactttgatttatagcatttcatcttctgttaaccttagttatttaatttttactttaaatattgtaattttatttatttatttatttatttttgagatggagtttcgctcttgttgcccaggctggagtgcaatggcacaatctcagctcgctgcaacttccgcctcccgggttcaagtgattcacctgcctcagcctcccaagtagctgggattacagtcatgcgtcaccagacctggctaattttgtatttttagtagagatggggtttctccatgttggtcaggctggtcttgaactcccgacctcaggtgatccgcccacctcagcctcccaaagtgctgggattacaggcctgagccaccacgcccggccttaaatattgtaatttttagttctagacgttccatttggttcttctttatgtcttcccgtatctgttcttattatgcttgcagttttctttaaatacttcaatatagttaaaatagctacttaaatgtcctcatttgctagttctattatctttgttattttctatcttctaggtctatttttctcctctctcttttactttattttgaaataattttatacttttctagaaaagtcacaaaaatagtagagtttagatatgatgttcacccagcttccctcagtattagcatacatgaccatactacaaagatcaaaaccagaaaatttaccttattgtactttcacctatctttccactaatacttttttaatttcagaattcagtctgtgatggtacattgcatttagctgccacatctcttcagtgttttctaatttgtaagagtcccggccgggtgcgttggctcacgcctgtaatcccagcactttgggaggccagggcgggcagatcacctgaggtcaggagtttgagataagcctgaccaacatggagaaaccccatctctactaaaaatacaaaacattagccagacatggtggcacatgcctgtaatcccagctactcgggaggctgaggcaggagaatcacttgaacccaggaggtggaggttgcagtgagccgagatcacaccactgcactccagtctgggcagtaagaggaaactccatctcaaaataaaaaaaagagtccctcaatattcctttgtctttcaatgaccttgacacttttgagagtagtagccagtttttttataaatgccccttaatttttgagatactttgaaactatgttaatatcctatttcttttacgatcatttcactatactactaactaataatactgacaaacactgtatagcatttatgtgcttggcattgatctaagcactttacatataataactcatttaatccctacaaaaattataatcatagagtgccatacgagccagaatagtgacacccacccaaagctcaaaagatgagaggaggagctgcttaaacacttgcattattatccctgttgaaagttagcttcttcacaataggaactctgtaccattcaagcttgtgtcttgcacggtgccgagcacacagtatgcaattggtaaaggatgagtacatgatagtcagacaggttgaataatctcagcaatattctcactaattgagacttgattgttttttccagcaaagtcgagatctttatctacctttaaagtgcctaagctgttttctgggtttcttttgggtccttgaatatgccaagctgtttccacactggtgcctttgtatgactggtttgtctctatgtgcctttttctgaatcttcacaggactggctccatcttgttattatcacttatcttaatcacttttccagagacccaatccttgaccttcctcccctacccccacccagctcctactcagtactctccataccattttcctgccttactccctgcataggaccttgcctgactgcttcacatatagtcatgccccgcacagcaatggtttgattgatggcagactgcatatgcgatggtggtcccatgagactataacacagagctgaaaaattcctatcacctagtgagttgtagccatcataacgtaaggttgtagcacattgcattaccttttatatgtttaaataagtttagatatacaagtacttactattgttttacagttgcctacagtattcagtacactaacatgctatacaggtttgtaccccaggagcagtaggctgtaccatatagccaaggtgtgtagcagactacaccataggtctgtataagttgtataagtacactctgtgatgttcacacaacaacgaaattgcttagcaacacttttcccataacatatcccatcattaagcaacacatgactgtacatacacagcacctaacttggggttgcatacagtagaccttcaacagatgtttgttgcatgagagaattaaccaaccaaccaatccatcaatccatcctggacaccccagacaggtgttcagcaatacagtgttggagtccttgacagccttgtggctaaaccttgaacttcaagagtcgttctgagaatgagttttctgtgatgcattagtatttgaagtccaaggacttattcataaactcactcataaacttgtatgggccttaaatttgtgtgttaatgttgctggtaataaatgaaatagatacagtctttaatctctctggataaagggctgtgaattttcttctgtcagttgattgaactgcacttactggagtcattttacgtagcatttagagattatttatattaagcccgcaacctaaattattgcagtttgagaatatatgtggtttttataaactctttgtattcacagaggcttgaataggagctcatattatgatttagctacaaattatttgggaatttggtaaactggcaattttgttttcttgcctgtttcactttacctttgatgccaagttgaagatctcactggcaatgtacaacataactgagctgaataataattgaaaagtgaaaaacaaaaggtattacacataccaggtgccattttggggaataatattaggaataaatccatgtgggtttatagttatacataaaatgttcatatacacacataacacacataaacacacatatatacacataagtacacacaaacataaatgcatacccacatatggcacagatacagacttaaatctacatagcctgtcctttagaattctttaaggaatttcagactagagcctttttagactcttgtactaaacattaggatacgctagcctacttgaatcctttggccctttgcttctcttacttacatcatttttctctttgattaatgtgccaagtttgggaaagcttcacaacatttccacaaactgcaaaaccacttgggtacatagacaaaagcctccatctttttcatcaagccatatatttttttttttctgaaactgatcacaggttgccaacattcttttttatttctagtttatcttcaatttaaatttaccttgtagtctcagaccctgtcatctttcaaggtttgtgcttctcggttctgcactgccaaagagactctcctctgtaaggcttaaattggatgtcaagtggaattgtcttttgtttgttcgaatctgtttcatattgtgctgctgtccattcccaaaatcatatttctcttatt

SEQ ID NO: 350 - DNA, 63534 bp, Homo sapiens
tgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataaactgccaaaatatttccttaggcttgtgtgcatttacagaaaagtgatagataaaagtcaaggtagagaaggtactggtgaaaagtaagagttcccacagtgagcccttacaacatgctaagcctttgtcaccgggctgcatacactttccctttcttaaaacaatgctgcagcgtgggactgtcggtctcatttcactgatgagtaaatggaggaaagggacgaaggaaagctacctgacagcctgtcatgtgcaggtttcactctccctcagtctccttcactcaactctgtgggcttttactggacattctccctgatctgcatctctgcctccaaatgggtgcccttcacacttgtgcccagccacctacagcttgttgctttccagctttgtccctgctgtcctcttgggatcagcctgcaagccatctgctcacattaagtaaggcaggccttcagtgagccttcgatgcagctgtcgcccttccctggcattggagatgtctgtctccttgagtaggatctcctgccctgtcactccaactacagtaacatctgccttgtttctgcagccctgtggcctttgccattgccttctcctttcatcacatacataagttaggaacacttgccattctgttgttgaaccatattctcccacctcctgtcactcatactcactcactgcaatgctgtcttccctttgacttcactgaaatttctcctttgatttctcctttcttctctgtaactagaacttccagttttactttcatcccttcctactttttttttttttttttttttgagacggagtcacactctgtcacccagactggagtgcagtggcacaatttcagttcactgcaacctctacctcccaggtttcagcagttcttctgcctcagcctctctagtagctgggaccacacacacccagctaattttgtatttttagtagagatggggtttcaccatgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatacttagagtaaaaccaatcaaatccattgtacatacctgaccatatgtcccagataaaaaggaaagacttgcgtgatgtttttttccttctgagtgccctgaggagatccttttgcttcagactatttctaatttttctttgtttataggttcagaattttttccatgattgttttcccccaaacaagtgcatttttaattactttaaatgcaggggtgatagaggaaatgctattcgaaccatagacatctttaatctgtgaagctgaaatttttcagcaaaggaaattgcatggtcaagttcagaaactggccattaatttcccccttccgctccacagttcatagctactcttgttgcaaacatgtagtgataaggagaactaacgtatcaaggggctgagagggtaacgttcccctcctcctccatgtttttattttggtgtctgttttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattgatccatatcttaacactggcaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataatgtgtctatggccaaaataaaacctgaaatccctgtcctatttcccagaggtaactgctgttaatagtttagttgtgtgcttccagacataccttcacagaatcatttatcacaataaaggtgtcatactatgcagattgtttgacaagatgctttttttcactttacacgggcatcttttcataccattgtgtggccaggccatgatttgttttccaaaagacatttacccaatttatatggtgaagatttttgtccatattactttttatagtatttctgtagggtaagttcccagaagtaatattgcacgatcatcgaaaaattttagtgttacattactgccccataaaggtactaattaacatccctctcaacaacatagaagattcctttttttttttttctttttttgggtggaggggggcggggacagagtcttactctgtcgcccaggctggagtgcagtggtgccatttctgctcacggcaacctccacctcccgggctcaagctattctcctgcctcagcctcccaagtagctgggaatacaggcacgcgccactacgcccagccaatttttgtagagaagggggtttcaccatgttagccaggctagtctcgaactcctgaccttgtgatcagtgctggggttacaggcgtgacccaccgcgcccggacggatttcttgttttcatactgtcatcaactttaaatacaagtattttcagtttttgccaatgctgttaatttagaaatgtgtatgtatatattgtctggtgggtgtttggatggaaacgatcaaaatcgggcaacttccccagtttccttgaagggagtgcttgccatcggcccctctgggaagtagctctccgtagttctccatcttcctgttttgaggaacgcaggaggaggtggatctggagtctcatccattcggtggctgttaacggcaactgcagcagccagccaggtcaccccctaaagcaaagttaaccccttgcatggtgccttggtcagcacccaccaaattcgaggtttctcctatccttcgactcgaggctcttttgacagatgtgatttatttcctcctagagccagtcacattggctcaagcaacctatcgtaagaaaacaaatacaatagtgttttagctggaaactgcccactgtctaagcggctttttaaattaagaactcaggttcactacgggatggcttaggccagggaacagcatgtgcgaagttcgaagcccgagaagtttggaggagcggccccaggcgcaggcgggtcccgcagcggggcccgtgccgcccaggcgatcagccccttcacttaacccgcttccctcctagcaggcccgagtcccctagcctcagcctcacgcagccagagcaaggggaagagggagtccttcgtgagttcgccgctcacattcggcggtgggaaaccgatccgaagatgcttttgtaggcgaaacgctcagctcgcgcggctctgaaccaccggggagcagcggctgctgctagtcggactacgccagcacctccttgtccagcccgggagcagccccgcctcgctcagggccgcgtgcgcgtgcgcggctccaggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtatcaggcaaaactttccccttagcattggtgacatctatacttgagtgttttatctaggaaccatttcgatttatcgactatgagacccgaaatcattgcaaaatgctcacttacctacaacgtaatggcaactcaattgtttaaaagtgtttatgatgaagatagactaaaacttaacaaagtaattgcattgggcaaaaaagtgtttacattatgttaaaaaaattacacggttgcagtcactttgtgaaatgactttacaaagaggaatattttagctaagttcctcatctgcagagagtcctctcagagctatgtatacccagagctggttaaatttattagaaccggaacgaccgtggtcatactgaggtcatcatccctagagtgctcagggtaaactgtccagcaaatgaagcttcacagtttattttttgccacaaacattccaacacttgccaggaacagacattcataatctcaaagttacaagtcaacagatcttagaggcattaaaagaaatcctcttggttttacaggagagctctttgccccttttcaataaacagatgtaaaacaaaaactcacttttatgatgacaagagtcagcacaggtgtaaatttaatttaaatattttagtcatcaacatttcaaattttggctgggcttggtggttcatgcctgtaatcccagcactttgggaggccaagctgggaggatcacttgagcccaagagtttgagaccagcctgggtaacacagcaagaccccatctgtattttttttaataagaaaactaatttaaaaagaaaaaaaacagccaaattttgctggctttaaactctataaccaaagtgaattagtttcgtttggctgctgtaacaaatcaccacaaaacttgacagcttaaaacacagacatacatttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaacacagacatacattcttgcagttctggaggccagaagtccaaattagtttcactaggctaaaatcaaggtgttgacagggctttgctctttccagtggttctcaggaaaacccagctcgtttccttgccttttctggcttctagagctgcatttcttggacgccttggctcatgtccccttcctccattttcaaggccagcatcttcaaatctccctctgcctccttcttccaaggacactggtgattgcattcagtggccatccagatagtccagggcagttttcccacccgagatccttatcagtccacaaaatccctgttaccatgtaaagtaacattcccaggttcctggaacatggacctggatacctttggggctgttattttacccaccaactgagctacttgtccatccagtgcttgccttctgagaaatgcttttatcaatggtttctgaaagactctttcaaagttcttgctaaagaaatatagcctctggttttaaccattattcaagcttaaataaaaggatttataagagtttgtgctgtacaaaaaattccaagatttagcaacatcttcttggaacattaaactatatttagtaataccttagagatagttatgttaagcttcactttgtttatttatttatttatttttgagacggagtttcactcttgttgcccaggctggagtgcaatggcgagatctcggctcacggcaacctctgcctcccgggttcaagcgattctcctgcctcagcctcccaagtaactgggattacaggcacttgccaccacacccggctaatttttgtatttttagtagagatggggtttcaccatgttggccaggctagtctcgaactcctgacctcaggtgatctatccacttgggcctcccaaagtgctgggattaccagtgtaagccaccgcacctggcctaaacttcactttaagaggcttaatcaggctgggcatggtggctcacacctgtaatcccagagtttgggaggccaaggctgatgaatcacctgaggtcaggagttcgagaccaacctgaccaacatggtgaaaccccatctctactaaaaatacaaaaattagcttggtgtggtggcacgcatctgtagtcccagttacatgggaggctgaggcaggagaattgtttgaaaccgggaagcagaggttgcagtgagccaagatcgtgccactgcactccagcctggatgatagagcaagactccatcataaaaataaataaataaataagagacttaatcaggaactttccgaatgtaccatgctactaatttctctcaagagccatttatttatttattttttagatagagtctttttctgtggcccaggctggagtgcactggtgctatctaggctcacggcaacctctgcctcctggttcaagcaattctgccttagcttcccaagtagctgggattacaggtgcgtgccaccacgcccagctaatttttgtatttttagtagagacgggggtttcaccatgttggccacgctggtctggaactcctgacctcaagtaatctgccctcctggcctcccaaagtggtgggattataggcttgagccaccgcgcctgaccaagaacaatttgtgagtttaggagaaaacccaggtattattcattcggcagtatatatgtaattgtaggttcaaatatgtttcagctgtcacaggacagaatctgttagggagagctattcaaaagtaacttgagtaaggcgggacttggtaagtgcaaaaatgaagggtcacgaaagttaagcaaagtagtggcttggtccttgagagattttgtaggcagagagattggggcttgggtggggtggagaggattccaggaagaggaagcagcacaggaagaagggggtggagacaggaaaaagaaaaaccatcaaaaccaaaacaggaaaccaggatacccacggacataactgctatagaacaagcaagtaggctgagcacggtggctcacacctgtaatccctacattttgggaggacgaggcggacaggttacttgagctcaggagctcgagaccagcctgcacaacgtggcaagaccttgtctgtactaaaaataaaattagccggccatggtgatgcatgtctgtaatcccagctattcaggatgctgaggcagaaggatcacttgagcccaggagttggaggcttcagtgagccatgttcacaacactctactccagcctgggtgacagagcaagagcctgtctaaaaaagaaaaaacaaacaaacaaaaaagatgaagcaagtaggcattcctctttcctcaggttagggttcttttcaaaggtgcttttcaggtgggcaaatatcaaagatgagccagcctccccctaagcctgtggactccactgtgaggggagtcggctgttccttatgacaccattgtgcagttgtgcctcacacaggacaatgaacataagaatcagtcaagtaatagaggctgctttggttggcgtgtgcctcaaggaactggcagaggctaacattagttggtctcacctcaaaagcaggcatttccagcctcggccctactgacagttggggagggcacaggaggaaggggcatcttgtgcatgatgggacttagcagcctcctggcctgcacccactggatgcctggagtaccatccaccctctgttgtgacaatcaaaaatgtctccaggccgggtgcggtggctcacgcctgtaatcctagcattttgggaggctgaggcgggttgattgtctgagctcaggagtttgagaccaccctgggggcaacatggtgaaaccccgtctctaataaaatataaaaaatcagctgggcttggtgatgcacatgtgtaatcccagctactcaggaggctgaggccggagaatagcttgaacctgggaggtggaggttgcaatgagctgagatggcgctactgcactccagcctaggccacagaacgagactctatctcaaaaaaaaaaaagcgtctccagaaattgccaaatgccttttggctggggaggagggtggcgggtgggggaaagaggaggagcattatcccccactgagaactctgcctccagaggctgtatctagctcgggattccttgcctgagttatgaggagttacccccatgaaataggtgaaaaccttgattagtaggaatgtggcaaaacgaggcacctattcttcacccacaccctttaggtctttaggttcacatttgtctaactcactgctgccttcaaatcattaacaaagccacaaaatggagctgaagttgtcttacaaagcaaggaaacaaagtcaaatttgaggggtgtaaagagagagaaaggatgagatatgaagtttattttagtctatcagatatcgacttatccatatttatctgtagcaatgtttctaactacccatggctttaaaattgttatctgtggccctggtggatgctttgatgttcatttgcctggatatgctgtctcttttcatcatgctaaagtcattagggccccaaatgatgtggcttcagcatcgccacctctggcaaagataccaaggggcgtgagtttctcagaaggtcttgcctggcacccctcccaccacgagccagaggctgggtgtgggttccctcttgacttattgccccaacagtttcccactcttgcccccaacataagcagcaatatcagtgtcccagaaaggaacaattaaggggaacaataccaggcaggaaaagtgggggtggggggatgggagccaggccagcacctgccattcccagtgtggaagtaggtgacctgtgtgttcctgggctgcctcagggttgaatatgcagagacgcttaaagtcaagcacctcaaaaagcagcaagaccaaacccacctgtcaaaagtgggaagacggccaggcacagtggctcacgcctataatcccagcactttgggaggccaagctgggaggatcacttgaggccaggagttccagaccagcatgggcaatggaacaagaccacatctctgtaagaaataattaaaaagattagccaggtgtggtggtgtgtgcctgtagtcccagctactcaggaggctgaggcgggaggatcccttgagcttgggaggttgaggctacagtgagccatgattatgccactgcactccagcctgggtgacagagtgagaccctgtctcaaaaaatttaggaaaaaaaaagaaagaataatacatggaactccagctgattgtgaagtggcagggaggaggggaagaatcacacatgttgaaggagcttctgcgagtgccagccactgcgccaagcccttctcacacaatgctccccaaccctccaacagggagtctcattatcccctttgccaacagagaaactaaggcaggcagagaaggttaagtcagagaaccaagtggaggaaccaggacataagcccgggatgttggtcttcagagctgtccttcctaatcaccgttgttttggggggttatttaagaaattggatcgcatagctgttttttgtgtattgatgagctttcagagatgtctgttatttattagctatttttcagctctgtcgagaggagatccacttcctgtaaaggacagaatggaaatgcccacggcaacccagaaaacagacacaggcctgactcaaggactcctgaaagttttgcacaagcaggtatgggggggcgtagtctctggcctcaggcagctggcctgtgctttccttaccgttcactgtgcattgatgacagagcggggcacaccccagcaatgtatttcaaacctcctgaggtccctgaaatcctgctttccctgccacgcatcgtcaaggttgattcaaggaagaaatatgttgtgtctgggaggtctttttctagcttcaacagccccaagtcactatccaggggtagagtttagaaaagtgaaatataatttcttttaaatacaaaatttacatgacactagattctgctgggcaaaacatacaaaatttcagaacctggggggtttccagtccgttctccaggtgtgtgtttgtgaaagctgtgcgcaggcctgagtaagcctctgccttctctgtctggaaggcggggctggcctttggcccccaaggtgggcagcagcctctggtgtccagtgctgtggagagcctgggcccccttcctgccttgcgcttctttgccccacacgccatcctgtttttacagacgtgagttactagaaagtgggtcacggagcaaggctaggccttcctcatgactcggttcttttgctaaaagagacaccagtggcataaccttgattttcaaactgacttatccccattctacactgtgaagtactgtgcttctgcgcaggatacagtgaattctgaaactaggactaccttaagggaagcaaagaactcttgaatggtgtagcttgcgaaaagacatgctgaaattgctcaaagccttttcatccaggatactgctagcagattgcagaagttttcagttttgatagattgtttaaaatagtagaaggaaggccgggcatggtggctcatgcctttaatcccagtactttgggaggctgaggcgggcagatcacttgaggtcaggagttcaagaccagcctggccaacaaggtgaaactttgtctccaataaaaatacaaaacttaacagggcgtggtggtgcgcacctgtaatcccagctacttgggaggctgaggcggaagaattacttaaccctgggaggtggaggttgcagtgagccgaaatcatgccgctgcactccagcctgggcaacagaatgagactgtccaaaaattaacaaataaatatataatagaagaaatacatttattttcagttttaagatctctcctatctaactgttaatgtgattaggggctggatttttaaaatgttttttactgagctttattttttattgtgaagcatttcagacagatagtggagtatcgtatactcaatatcagtatgcctgtttcattaagtcataacatgatgccgtattcgcttcaccgtccttttttcatttaataaataaaaggttgccgctcgctgccttccctgccttccctccccagggctgacagaaccccctgtcatgcatttggagttcatctgtcccctgcatggggcgggttacttggtgtgtgttgaatattcacagcattcattgtttcccaggttttaaaacatacataaattgtcatgctgtgttttccaaacagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtggggtatgtacctataaacagcatattaataattctgtgtcatcatggtcccagcttaaaaataatttaggtttcagtaactaaaggaaacactttagtaactttgtcttagaaaagcatttccccctgctccaggcctattatattaatattttcaggtgtacagttattttaatttacagaaattatttatgaatgcctcaatttaaaagttaatagtagatgaaagatatggatactattaaaatatatttaggttttagaagaaaatgcatcaatgactttttaaaactacaaatcattttgtaaactgataactgttttgctcatctgtggaaagaggcatacaattattttctactttagtagaaatctattattattatttatttattcattttttttgagatggagttttgctgttgttgcccaggctggagtacaatggcgcaatctcggctcaccgcaacctccgcctcccaggttcaagcgattccctgtctcagcctcccgagttgctgatagctgggattacaggcatgtgccaccatgcctggctaattttgtatttttagtagagacggggtttctccatgttggtcaggctggtctcgaactcctgacctcaggtgatctgcccaccttggcctcccaaagtgttgggattacaggcgtgagccaccgcgccggccttagaaatctattattaataactaatagatacagtgagattttgctgatgtttgagtataagccaagcaacttaggaataagacatgatcctccaggtgacgaggcgagcctgggaggtcggggcgagaagggagaggttggagctgggatgatgttggcagggcttcctttgcaaacccagagtcagtcttctcagctaaagtcttgctgtgagacatggtggttgggtgaaggaagagtaaccaggcatctgccatgtgaagcttatgaagaaaggaggcagagaaaggagaaccagctccctttactacatagatgaacaatttgattttcccccctcccttcagtctgtggccccagtgtgtataactggtccttgcttcacagccctcactcagctttgctccatgcacagagctctttcattccattttcattaaaacaaattacttgaaatgggtggtggtaaacacccgcaaggctacccaatgtggccactaatgcaccaacagtcacttccaaccacctgtggcctcctcccatgtcctgtccccctgcctggtggcctgaagcaatgacatttctgaagttcctgcttctcgcttcctgacctctgaaacacatgcttctatgtgtcccgcaagaggtacactgtggaattttagttggttttgacttgatgaaaagacatttgtgttgtcagtaattttctgaaattttcatcctaaattatatgactagatgtattcatctgtacatcacaggccacgttgttcattcccttccttcgccatgtcacatctgagtgtggcgcagttcaccagctctgcagatggccccagtgggaagctccgtgccctcagggagtcgggtgtggtgtggctgtagaatgagcaagagttttgttgtgtaactgctcaaaggcaatggaggtgcttcctgtcagccccgggctaattgtgccaaggcctggatgttggcaggcatggtaccctccagtagcaaggacaggtgcagatggcaccaggggagtgtctcaggggtattatcaagatagacaaaggcaaatacttttaattattggagacatttttatgtcactttgttaatctggaactctgtgaaatctatctatctatctatctatctgtctatctatctaatctatctatctatatctgtatctagctatatgttttttgagatggagtctcactgtgtcacccaggttggagtgcaatggtgtgatcttgactcactgcaacctcccaggttcaagtgattctcctgcctcagcctcccgagtagctgggattacaggcatgcaccaccatgctcagctaattcttgtacttttagtagagatggggtttcaccatgttggcctggctggtcttgaactcctgacctcaggtgatctaccagcctcaggttctgggattatagattacaggtgtaagccactgcacccagcctaaagtatatgtgtgtgtgtgtgtgtgtgtgtgtgtctgtgtgtgtgtgtgtgtgtgtgtgtatttttttttttttgagacagagtcttgctctgtcacccaggctgtagtgcagtggtgcgatctgggctcactgccacctccgcctcccaggttcaagtgatttccatgcctcagcctcccaagtagctgggattacaggcatggacctccacgcctggctaattttttgtatttttagtagagacagcgtttcaccatgttggcctggctgatcttgtactcctgacctcaggtgatctgcccgcctcggcctcccaaaatgctgggattacaggtgtgagccactgcacccggccctgaaatcgatatgttaacaatataaaattgtatgcaatgtttgaattaatgttggtggtttctgcctctaagcttagttgtaaaattttgattttaaaatgatgagaaagtagaataattcatgtttttggatccatctttatagttttcaccttcctaattgtgaaaattaagcactagatttaaaacacaattgaatctgatttgaaaaataaggcctcttgtccatgtagagtgtgtgacactagatggagacattgtgttaaggatagagcttggccgtctaagctgactcctggggaagagacatcacaaacagcacacattcttttgggttcttcctatcatagagaataaattgacaccaggaatcatgctgtgcatcactgcgggttcctgcctgtctcctgacttgagccacctttgccagcaggactccagatttgcccttgactccttccataggtgctggaggcctctcctggttgtagaaagccacagccaccctctgctctggtccagtgcggctgtagactcagggtcaggttcaagtgtggaagctgacctctcctccctcagaggagcgtgtgctcgtctggggtccatgtctgctgccagggatgcctgctctgccctggctcccgcggcccacagagtgctgagcacgagttcaaacacctgtctcggggtgcgctgggtagacaggaggtgctcggaccctccaggccttggtgtggacagttgtgttgttgaccttgttggccctgggtggcttggaggtgtgctaagaacacaaagctgtgaattcaaggaggggtttcttcatgtcgttcagcgtcataagcgttcatttttatgctttaaaaaaataccttcaaaaaggaggaaatgaagtgcgatgagaataatttgtagtggattaccacctgcagaagtttatttcacataggatgctgtgtaattggtggctagccgctgcctgcgtgagcgggatagatgtcgttcctgctccctgcatctatggcgggggcgtggcttgtggcaggtgtactctctgtgctgtttacatttatttatcttagaaatcactctagtcaaattcatcgagttgaagatctctaaaaagactggaaacctctgcttcaatttctgaatcatacataccattcattccacaaatgtttactgtgcattattttgtgccaggccctgttctaagtgctgcaggttctggagtgaacaaaacgggcaaacatcaccagactcttggagctgatgttctgttatatccttgaagccctgaacactgctctacttattacatcaaaagctatcaattcaggttaaggggcactgtgagctgccccaggcaggtgaacaaggacattaaattgccatctggatgttaagagattcctgtcctctttctcaatgttttgatgtgcttgcatggtgaaatgaccatatttgtatgttgtggcttttatttaatttttttttttttaagagacagggtctcgttctgtcacccaggctggagtgcagtggcatggtcatagctcactgcagcctcaacctcctgtactcaagcgatcttcccacctcagcctcccaagtcgggattacaggcatgcagcaccacatccagctaattttttattttttgtagagacaagtatcttgccatgttgcccagggtgatctcagttcctgagctcaagcagtcctcttgtcttggcctcccaaagttctgagatttataggtacaagccacagagcctggctgacttttatttttccatttctacaatgccattaatgatcctgagcattaaagctgtggatcaaaatgttttgttttgtcttttaagcatggagatctttttttttttaagataagaaaattgtgaaccaagtctttcatccccatactgacactgacagagtcagtctgtcatgatcaaaacaaatcacattgactttagtcaggctttgaaacgcatttgaactttcttagtcacagaagcatcattcttcgtttacaaccacagatgcacacgtgtctaacgcagttttccatctgaacacggtgcacgcagtgggcatgatttctagggtttaaccgggtgcgggagtgcacagagccctgcgtgtgtattctctggaatcctcccaacagccctttgaggaaggcaccatcaggattgcaggctggtgccccaaggcagagagaagctgagtcacaacaggtgacttggaagtggggagaggggaggattcctcctagtggctccatagcccaaggaatgtgcagcccacaggttaggaccaccttattcaagtttacgcctgagatttcctgtctcggagaagaacaactcctcgggacgatcatcaaaatcattttgtgtcctgaagtgattcatcccctggaaggcattcaacctcggcctcctcctgacaacacacactttggagctctcagaacatcgccccatccagctgtgctacagcatgtcagattcagtgactgacctatggtggttccctgttggtccgatgtgacagccacctgcgctgcggcagtgacagaggctgcatcctggcttactcctcgctgctgtttccttccaggtttccgcagctagggctcgaaagcccattcggaagtgaccaagaaaggccaacagaattcctcatagcccctgcagcccgtgagaagaagacacagccacgcccccaccccccagtgggagcctgaggccacaggcgtgtttaggaagctgtccctgaagacgaaggagccgctcaggctcctgactcccctggccccagctccagttcccctgattgctcatgtccctccctctgtgggaaagaggcaggggccacgctcccctgaccaaccttgccctgtccgctggagattcccatgggccgctgatgcgggccgctgtggcctccccatccctgtcctgcacaggatatcacaccccagccacggggtgaactgctccttcccattcagggcctcctacccttacctgctgtcagccccagaaatggttttaaattaggaaactctagaggataatagaattcgatgaaaaggcccttaagctcttgaaaacgcagtgctgggttagaggcttttaaaaaccagtgctcggtcagaggcttttaaaaaccagtgctgggtcagaggcttttaaaaaccagtgctgggtcagaggcacagcttcactggaagtccagtctctacccccagcacaggcagctgtgcctcagagggggacctcctttgttctgattctgtgtaaaacgggcctattttcatttccatgccagctgagaggtgcccttggggaggtgtgaggtgactgttgaggggcctcatatcatcatgagagcagctataatttggaaactgaaaaaccccacagagttggcatgccgaaaatgcccggaaaatagtgggtgccctcgtgcctgtgctcttcactcatctccacttgaatttcagattatggatcaggtgtaaatacttggttaaaaactaagtgtttggctgggtgcagtggctcacgcctgtaatcccagcactttgggaggccaaggcgggtggatcacctggggtcaggagttcgggaccagcctgaccaacatagtgaaacccccgtctctactaaaaatacaaaaattagctgggcatggtggtgtgcacctgtaaccccagctattcaggaggctgaggcaggagaatcgcttgaacccaggaggcggaggttgcagtcagccaagatcgcatcactgaactccagcctgggtgacaagagtaaaactccatctcaaaaaaacaaacaaaaaaataagtgcagcttgccagtcacctctgcccagcacatatcgcacatgggagaataaatcagccacacagcagacggcagcatggggcagccatgccaaggagagggtcttttggctgttgtgcaagtgactgtgccacccacaggcctttggaattgagaaacaaatgttaagaaatgtgactcgcagcacaagatggagcaagttgccttatgaatccttctggatataaaaattgctgcagatcttattgtcagaaacgttgacatgggtagtgtcatcacgcctttgcagaggaagtgatgctcgagtgttttgatgtatttttccttaaataccgcttcctctgaagccttggaacggcgcgttacacagatctcatctgcctgctccatccacgccaactccttcctttccgactcatccttcctgaggccccgcagtcctgcacacggtggtgacggacttccatttgtgtccagtgtaaaagcaaatcccatcataacaacatgtctttgagagtttcaagcaaggaacatggattgtgaaatacacgactcggctttgagcaagtcctgtcttggggacagtcttttagaggagccacgtgtgcagtggtcctggagcggtgcctgcagctccacggagcaggttctgcacttttcctagagagagcatcatgttgccctgggagctgcactcaccccctaaccgtgccgtccacctcggcagcatcaggtgcagccgccaccagcactgctggcatgggaagggggtggaaatgggaggaactgccccatcaggccgctggggacagggagatcagttctgttcagggctccatctcctgcagccaaatatctgggtcctcagataggcgacgtctgtgccccaggtcttgttcccagagcccgcctggcggctgctagacataataaaatggagtagtcactggggtgagctcagaggcccaccggctgtgctccagtcctggctgggtgacttgggtgattgctgagcccctctgggcctggccaaggtgtctgtctgctcctcgcagtaaccacacgaggtgactgtcattattctcactcccagaggaggacagcgggctgtgttatcagccttgctctgaccatggtgttctgtagggaaggctcattttgtcccatagcctggagcggcctcagagccctttcctgtccctgaggatgtggggtttattcctgacacagccactgtggagctggacagtccaggcctggcttgcagcggccctttccctgcatctgcagctcccccgtgaggatggtgctccaccctggccctcctgtgtttgtttcttgcgcttcccttggaagcacagccctagattcatccctgcaggcgattccccagggatgtcagccacctccgtggctgctgcaagcaggagctctcagtctgccctcacaccccaccccagcagcctgcagggcaccaccctgctcgggaaggtcctggttctcagtcatgtttgccaagcgatgtggtgtaaatactcccactgctgctgagttcaggctgccaaggtgaagtcctccagctcacacaactgctggaaacttagcagtaggctcatgagccggctccagcacagcaccgggctccgaggaaatcctgtgccacccgccagtccttgtccttcctgtcctgtcctgtgtgctttgacacaggagattgctctctccaccaggaaatgcttttcttcactcaccagcagcctccctcctggctgcgcctttcaagtccccatgctggtccctcatctccccagctcttggtggtatagcgtgtccatgcactgtcctcccacctcggcaacctcgtggggctcggctgtatacaccgtcctgctcgtatacactaccccacccatgtataccatccccccgtgtataccatccccctcatgtacaccatcccgctgtgtacaccatcccgctgtgtacaccatccccctcatgtacaccatccccctcatgtacaccatcccccgtgtacaccatcccccccatgtacaccatcccccctatgtacaccatccccctcatgtacaccgtccccaccatgtacatcatccccccatgtacaccgtccccaccatgtacaccatccccccatgtacaccgtccccaccatgtacaccatccccccgtgtacatcatccccttgtatacaccaccccacccgtgtataccgtccccccatgtacaccatcccctcgtgtacaccattcccccgtgtacaccatcccgcccatgtacaccatctcacccatgtacaccatccccccgtatgccccatccccccgtgtacaccatccccccgtgtacaccatcccctcgtgtacaccatccgcctgtatgccccatccccccaccgtgtacaccatcccgcccgtgtacaccaccccacctgtatacaccaccccgcctgtataccccatctcgcccatgctcccaagtctcctccgtgagcgctaggcctactaagtagccacctgagtcaccagttccactgggcgcctgacagacatgtcagtggaagccaccccaaactcagcttctctctggaacttttgcagctgttcaggcaccaaacattggaaccacttttcatggttctgtctctgcccacatgcaaccaccagtgagttctggtaactccaccttcaggagaggctgagtccggcccttcccaggcccctggctggattattccagcagcctccttgccaggttcccgccttccaccctcctcaccgggttcccgccttccaccctcatcactgggttcctgccttccaccctcatcactgggttcttgccttccaccctcatcacttctcttcacacatcggcagaaggactccttagaaacactctacagtgctccgtctttgtttaaaaccctttgacaccttcccatagaccccagccaaagcccaagtcctccctgggtctgtaaagacctccgtgatctgcccccaccccatcccgctgacctcatttcccgcatccctgcctctccatggcctgctctagctacctggagctcctggctgtttctggagcacacagaagtgcccctggaattctcccagcatcccacatgactggctccttccccctgggtctgtgcttacatgctccctgctctgaccgtccctgaccacccgattgaaaatgtcatcctccaccccggcactgcctgcctgctgctccaggcacgccctcttccagagcaccctagaatccaggtgttgtggctctcccacttgactgtgatctccacatgagcaggcgttaggtgtctgttcactgctacatcctggtgtgtaacaggcacttggcaaacgtggagggaatgaagggctgttgccatgtgtgtgtgttggcgaggggggttacgtttaagcagccacctgtgtgagctcaccttcatcagtaggcagcgtgaccatccaggcaggtatgagatagccactctggcaaggacggccttcacagaagggactcgaggtggggactgaggggagggtcccataggccagctgcggaattaggacacctgcccccacagcttaccctggccagggtgttgaaggctgcaggtcatgatgtcttggtgcagaaggagaaaaggagacctgggctatgtgttctcttttgaaaagatagtaatcttatgttacatggttctcccaccttcttgaaacaaacacacaaacagctcatgttttttcaacaaggatgaattgagcaagttggaggtgggaggccatgggctggccctggggagccctggtgcccaggccctgcagttccagcgccatgcagcctctggtctcatgaagacgaccttggcctgttagctgccccccacccccgcagggacttggctgggagggcaggtgctaaaagtgtctgccgtgtggaggcaggaaggctgctcagaggatgggctttcccgctgaaagcagagggtgggctgctgtctgggatgagcccagcagtttggaagagtgtgagggagatgaacggtctcagggaggaagtccggttgctgttctggagctgagacagagcccagagccttctgtgtgaacagggagagagccaggacagagcccggacagagccctcccttctgctcggtgggcaggcattggcagacacccagggcttccttgtaggcatgcaggccgttggctgccagccctgccctctgcaggcagcacctctggctggtggcagagttcattcagcccctgggcacgtccccgggtgtgtctccgggccagatggggctgcacagttctgcattagcttaggaagttggttttcaagacattgatgcttccttttgtctgtaacagtcatttctattttaatagaaaataagatctgtgaattagaattttttcctggtcaattgcaccccattcgaacctttccttttcatttttcattatggcaattgtacattcacctagttctcagttcagatggagcacatactttttggagaatttctgtcaaatatgctagagtgttgattctgctgatgcctgctttcaatgtgagtgatgccaggagtaactgtttttctccccacctggctgtggtgctcccagtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatgtaagtatgcaccctctctaggattcaggtatgttgaccatgggagaatttcctgtttcacttcccccttgtagggaaaaactcagtttttcctttgctctctcaccacaacaataatcaacacagaagactgctatgatcaaatgtgtggaggtttttcctcaccaaaaagcaagcaagtggtcctgcagcagacaccagctgtgcattctcattccgtctctaccctgtctacctggagatagcctgagatcccacaggttgagggttcagtccccaagactgcccccaccctgccccatttctgatgctagttgcaagccccaggttattttgcctgtgcttctgaccgactggctctaaatcagggttcccacaacccctccttgggtcaattaatttgctagaatggttcacagaactcagggaaacactcatgtttactatttgattacaaaggatattttaaaggctaccaacagtcagaggaagacagacaaagggcaaggtctggaagggtctggagcatgggggcttttgcccccatggagttgaggtacatcccctccctgcccgcaaatgagctcttgttcaccttcctgttggtctcgatgtgtttagcttccgggaaactttctaagccctgtccttttagggtttctttttcctggaagctttgtgattgattaaatcattggccaatagtgatcacctaagccatcagcccctctccccacctccaaggttgggctgggctgaaagtcccacccctctaatcctgccttgggctctccagtgaccagccccatcctgaagctacctgggccatcagccaatcacaagcataaagaaagaactcactttggagattccacagattttacttgtatgccaggagcgggggttgaagaccaaatatatatttcacaatatcacatcccttgtctgcaataactttgtcccaacgaatcccgtgtttggcagaaggtttaggcacacctgatagtattcagggtgtgtgtaagtggagccgcagatcaaaggccatcagcgaaagcaagcagcacctcagaagggagcccgacctctcccgtggctcccacccatgtgggctgaggctcaggtttttttagactttagagggagagaatgtatcttgtcattaagactcatttatcccagatctatcctgattcctatgtacagcatgtcaggtggtactaaattgtagcatgttaaaaagtgagatagaggctgggcacggtgcctcacgcctgtaatcccagcactttgggagtccgaggcaggtggatcacttgagatcaggagttcgagaccagcctggccaatatggcaaaactccatctctactaaaaaaataaccaggtgtggtggtgggtgcctgtaatcccagctactcaggaggctgaggcaagagaatctcttgagccctgggggggcagaggttacagtgacccgagattgtgccattccacttcagcctgagcaacaagatcgagactccgtctcaaataataacaacaataataataataataataataataacttaaaaagtgagatagaattcatttctccacaatgaaacgtagacatggattactgctggtggacctcctgacagtagtgccacggatgcaggatcatttgcagaaacttgaggatgtcattgacatcagccacgcaattctcactctgatgaacttgctatatgaccccgacacattgcatgttatgttgtatttgcaccaggctgcatgtgatgtaaggctggttctgctctgaagcatgacttggagctaacgttggaatatattgtccagtgttctgatcacctgtaacatttttaaacaagattaatgaatcctccctttaaagacaagatgcagagtaaaaaggaacaaagctcttgggtcctgcggaagttctcatttgttcattccctaaaccatcattgggtgctgactctgcaccctgcactacctatggggaggcagagagagcagcccagggctggtggggtgggcagaggtggtggtgacaaccgcagggtccggggagctgtggtgctgcagagtaagcctggttaacagcaagaaagggccttctaggtgcaagggcaggaaagggcccaggtcctccaggctccagccccaagggagatggggtccctgaggtcttcccggcacttccccttgggaccactgccccccaagtgctggttatggtttgtccctgagccccacacctctcatctcgaattgcccacagtacagtttattgagcacctgctctgtgccaggcattggcgcaggtgccggggatgtagtcagtgaacaggtcacgccctgacccctggagttttgccctgtggagcagacagacatcagacaagcagattttaagacagtaggtcatgttcagtgccaagaggacagtaagccagggatagggaccaatgggggctggtcccagggccgccttctggcacagcacacacccctgctcgcctcagcctcctgagaagccccctggcctgtcatcaccacccagagtcttgtcccctcctcccaccctttccaaccggccatgatgccacctaggatgcaggccacagcaccaggagctggcgctcaagtgatccgccagcctccgcctcccttcctgtgccagtggagcctgcgttctgtgccctgccccacctgtcccagccgtcctcgtctccttgtcccttccacatcgtttcctctccttccttcaaactcacatcccctctgcccaccatgggctgagcctctggactccatggtccctctttttcctccttcctctgtcatccactgtcactccaaccctcctgtcctcgtggaagaccgcagctcccaagccatcccttctgtccgccttattcttgacaccatcctggctggtgtctgcagtcacatggacgacacagtactttgtccccagctctcctcctggtgcccacagcctctgcttctgcaccgccatccgggtcatgctgggccccttctcctgcccgatccgcgcacctcttctcttcttttgtgctctctgatgcggctactccgcctgacagagccacctgggacatgggtggttccatctcattccaaatccatgtcccaagcctccaaagaactgggaccctgtgcagcagccacttctcccaccactttcctgagatcacaagtcatcaaaaaagaaaaacctatgcatatagcacccatcttttcacctagaaataaagctacatttattatacgttttggtgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacacacctctgtagtgtgagtgtttctctaaatgggaatttagtgtgactgcttcgtggggcctgattcatgattgcttttcactgtgtcttttagggaccttaagtgtaagaagttgataacagtaaaatgatctcttttaagaaaataatctatttggagactgcagagtcagaagtggggctgggcagtttgaaaagtggctttttgggccgggcgcgttggctcacgcctgtaatcccagtgctttgagaggccgaggcgggtggattacgaggtcgggagatcgagaccattctggctaacacggtgaaaccccgtctctactaaaaatacaaaaaaattagccaggcgtggtagcgggtgctgtagtcccagctacttgggaggctgaggcaggagaatggtgtgaacctgggaggcagagcttgcagtgagccgagatcgcgccactgcactccagcctgggcgacagagcgagactccgtctcaaaaaaaaacaaaaacaaaaacacaaacgaacaaacaaaaaaaggggctttttggtcaggcgcagtggctcacacctgtaatcccagcactttgggaggctaaggtgggaggatcacttgagtcagtagtttgagagcagcctggctaacatggtgaaaccccgtctctactagaaataataaaaaaattagccaggcgtggcggtgggcacctgtaatcccagctactcaggaggctgaggcaggagaatctcttgaatctgggaggcggaggttgtagtgagccgagatcgcgccactgcactagagcgagactccatctaaaaataaaaaaaaacaaagtggcttttcttcttcttgactccaagctggtggaggggctcgccctttgctccctgcctacccctcctaagactccctgggaagggcattggcagctgaggctgcatcttttctatgaaaggtggaccccagggaccctgctgcctggcctagcgtccgtggctgggggaaatgtactggacagcagcgtgatccacttgaatggaaataagcatccaagatcctttatttgctttccttttataaagttttcgaaaaggccaataccaatgaatacatttcaggttagcttccaggccagggctcaggccctggagaaaactcgtgcgaatgcctgtctggggggcccaaggagcgagtgtgggcccctctaaaacttagagggacagattacatgacgactttggggacagcttgctaagtgtccatttggcagcatctgggatgagacgtgctttcactgtgactatcttgttgggaggtgatggggaggggaaatgaagcccctgcctcctctaaccctggaggctgcccacgtttaccaagagaatctcacccaatgctgaccagctcagcgtgcaacacagcatcactgggctcaagaaaagacatttgaagacgagttttgtaagcccgagcataggtgaatatcaccgtaaataaactccaacgtgaaaatctgaatgtataaagcataaatcaggaacagcttttcactcaatcaaaaaggcatgtggtgtttcagtaataaaaagcatgaagtgtggagacgcgcggcagcatgggtgtgatgaggcccgtccctgctggtgaacaagtcctggcctttgtcccttgaaaaggcttttgtctcaaaaagtgggttttcttgggaatgacttggtcatagaaggagaaatagcattctgtatgaatcggtgagggctgccagaacgaagcaccggagacccagtgcttacgtagcagaaacacttcctcactgtttcggaagcagaagtccaaggtgaaggtgttggcagggctggtttctccggaggcctctctccgtggcttgtggttgctgtcctcctcctgggtcctcacatggtcttcccttgtgcctctccgtgtcctcgtttcctcttcttattagaacactggtaatattgttttagggcccatgctaatgacctcatgttaacctaattaccttttaaagatcctgtctccaaatacaatcacagtctgagttgctgggggttccgacttcaccttgtcaattttgttggtggggactcaagttcctccgcgccacattacttctcccagccctcagaatggttttagcctgacttggcaagtgagggctctgaagttcaaacagattttcccatagaaacatgcactggctctacaggtataaaaagaaatgtaaatagaaaaaaaaaaaaaccagaaacaaaacaaaacaaaacacaaactggccttgtctagttgacacaaaaccaaaaagtatgtgagacagatctcaatcaacttcgaagtttattttgccaaggttaaggacgtgcctggaagaacaaaaccacgggatcacagaggcagtctgtggtctgtgcctttctccaagggtgatttccagggcttcactgttgaaaggggagaagcggtctggaggcgggaggggaggatgtggtcattactgaatccacaggctgcaagggaaaagttgcagacagggaatcgtcagttatgtatcttatggtctcgtgctcagtaaatctgcgcttcacccaagataaggtgaacccagagctgctacctgaggagattttaactttttctctgtagctctgtgctgaggagcaaaaggaaaggcagcttcctgcatgactcagcttgcagcttcatttgttttccttctggcagagtgaactggggtcccaagtttcttttttcctttcatgacaccgtctgaacacctgtgtcgtctcagagtagtgaccaaaatgccaaggcctcattcggaggataagcactcatctgcccagccagacccaaggttttcagaacactccttagcgtggactctgggtctggagcagagtggaggtgggcacccaggtcccgtcccctgagtgctgggccactggccggctcagcatgagactcagacgcacagcccttagatcacccacacatcggagtctcctgcttaacgctctgtccctgtccctcccccagcacagttgggggtcttcgtctggttcctggtcactctcggctcagctccagcccccaggggttgtccctgcctcacggttgactgtcaccattggggctccaagtgcccagaggccgagctccatcatgggtggaagatgagctaattttgtaattaacaaaacataaagggggatcactctccatgccatttagtgggggagctttaaatatcttgctctaacacctgattaatgtgccatgcttctgtgagcaaaaagtggattgtttgtgcctcataaaccggattcctaatcccagaatactcaggcagagggcttcctctcatcaaggaaaacacgttccctattctgttgattttgactcttcttgttacaaggctgaatcatctatgttccccttcatagcctgcagttatttcttgttaaaatagccataggtagttgggctttcagtcagattgttgcttgtctttagggggtaactcaaatggtttatttaataactacaaactttattgcaaatatcattaactggtcaagatgttgaataaaataaactgttcaggtggctggtgtgtttgaagaaagtagctctgggaggagaacagcagaaactcccttgctgcaatgaacatgggaggaggtgcctgaggaccctaacgggattgataggggctccagtacaataatgggagatttgctatcacgtggagaggaggccacatctggatttagcacctcaagagtcaaagacaatttttccaattgaagtcactttaaaaataaactttgggctgggcgcaatggctcacgcctctaatcccagcactttgggaggccaaggtgggtggattacgaggtcaggagatcgagaccatcctggctaacacggtgaaaccccgtctctactaaaaatacaaaaaattagccgggcgtggtggcaggcgcctgtagtcccagctacttgggaggctgaggcaggagaatggcgtgaacctgggaggcggagcttgcaatgagccgagatcgtgccactgcactccagcctgggcgacagagcaactttctttaaaaaaataaaaattaaataaactctgaagatgatggagcgtttgctggcactgtggctcatgccttaatcctagcacttctggaggccaaggtgggaggattgtttgagcccaggagtttgagaccagccctagcaatggagtgagaccttttctctacaaaaaaattaaaaaaaaaaaaaaaaatcagctggaagtggtggcatacgcctgtggtcccagctacctgggaggccaaggtgggaggatagcttgagcccaggaagttgaggccacagtgagctatgattgcatcactgcactccagcctgggcgatagagtgagatcccgtctcaaaaaaagaaaaaaaagttcctggcattcatacggtgtgactttgaaaaacacctgcttttccttaattgcagtgtggggaggggggtggtgggaagcagaattgaaaaagctacaagatgcagatgagtggacagtggttttatcttatgacttaaagaatgctctgtcccattgaaatatgtgtcttaagtctttgtccaggcagcaacgagtggcttatttggtttcaagctaactttatttgttggcttctgtatttttcatctctaaagaaagtggagtatatttcttctgttggtttatgaggtataggaaaagaatgaaagcagggatgactccagaaatacgtgcttacccagcatggtggagttctgaggtggctgggcagggccaatgatttgcttttgaaatgattgtgctaagagtcacacattgaatttacgattagttgttatttcttggcaatcactaacatacttgtgaattctcattgtgtgagagaatctaacttacaaatcgttttcaaatgtagtgagatttttatgtatactaaatttagcaattaatgaggaatgaacacagaaattaatcatttattgagtctgattttgctatttccgtaatttgcagccaataatttttttcaagtcttaaacattctcagaggtcgatgaaacccttgtcagcctgcggctttgtgccttagcatctcaagaatgaaatgtgttcaggtcccccgtcctccaaggaaaatcccaactctattatgttgctttgtacaatttgtacaattgtacaatcccctggttattgaaggggatccccaccaggaccccatgaagtggacagaagtaggattaaccccctttagaggggactggcctagaactaagatgccaggggcagccaggtcctccttctgcccagggtccaggcccacccacctggcctcacactcctgtccctctcaactcttccatccaacagcattccccgtatctgtcccatttccccgttctggcttttggtaaggccagaagcccccacaggtgaaagaaactggataggtggggttgggttgatgtccactgtttcctggaaccttcatgctttccccgaggttggagcagggatcccacgctttcctgtgctgagttggagccagttggcctgggatatggaatggctttctgggcacatgtcccacctcaaaccccagtcccattcttgaatctcacgtaaagtattagcagggcgtgatcaggagagccacacagcatccatgaagtgccctggccgtggggcctcggggccggaaggacatttgggttgggataatattcgggcttaggtgaaaatgcatttacccagcacctgctaagggctggcccccctgccacgtacgggttttgcagctaattaagttctcatcccagtggcagggaaggctgctgtcattacccctgtgttatggaggcacacttccttgtccaaagtcccccgggtggaaaggcagggactgttactgggtcctggcagtccgactccagagccttggagcccaactccaaaggaaaggtgaagagtaaagtggctcttggggaggggacagtgatgagtgggagaatttgttccttgattctcttttcttttcttttttcttttttgagatgaagtctcactccattgcccaggctggagtgcagtagtgtgattttggttcacctcaacctctgtctcccaggttcaagagattctcctgcctcagcttcccgagtagctggtaccacaggcacaagccaccactgctggctaattttttgtactttttttttttttagtagacacggagtttcaccatgttggccaggctggtcacaaactcctgacctcaagtgatccgcctgccttggcctcccaaagtgctgggatgacaggcgtgagccaccatgtctgatccgtccttgattttcaattggggaagtgtgtaggtggggcggcctgttaggaatactggaacagggttttcgaagaaggtttcaaggagactgcttactaagatatggggagggctgaggggagcccacaagggagggtgcaggcccctgggctggctgcggtggggttttatgtcccgcagcctgaaagtgcaggagaagctgttgcggggatccacagagatggcagggctgaggagagggctcttggtgagagctgtggctttagtacaggggtagccaccccccacatccccccagggaggtgactgggggataaataccctccttccatttgtcttccatcctgggatcttccatcagggtcttgtcctggctgagcacaaccagaatctggagagaagaaagcctcatgatacacaggtcagctatgctgggctcagagcatggaagagccaggagaggctaaaggaatgtgctagacaaagaagtttgaaatatccagcacacggccattcgatgaagacatggtggggtccagcacacggccattcgaccatttgggtgaagatgcggtgggggagactcatacctccacatattcatatgcatgctcacagtgcatacgttgtttctggaatgatacacagaaaaaactggtagaaacctccaaggaggagaagttgggaggaaggctgcctgtgtctcattgtataacttttttctaccatttgattttcacttgtgcatttattatgtattaagtccacccatcaaccgtgcatttattatgtattaagtccacccatcaaccatgcatttattatgtattaagtccacccatcaaccaatcatgaaaaagaattggtgtctgagttctttgggcttggagtgtagccaacagggaatgcttgtgatctaggctgggcccatcacagtgctcccctcctggccaaagtgatttgcccaagagagttggcacatgacctgcacttgacggatgagagccttctctgggtttttcggcttggtgctgggagagagaggcccttttcttcttcctttgattaaaaagcttattaggatatgggtctagagttgtaggtgctagtagtcactaacatacgtgacactgttatgttgaaacatgttagctactgataatctcaaattttcatcccccaaacagcaatttcatctagctcaaccccatacgtgccaggcctcaaggagagtggattatacagggcgtgttcaccaggagggtggggatttgggggccatcttagaattcagcctgttttccacacgctaactcatttactcttcataaccatgttatcaagtggaaattattgttattaacctcatagccattatagataggtgaagagaaagagagattaattaagttcctagtccaacaccacacagtggtcctgcttgccctgctctcccagtctgctgtgagcccagcatggagcctgtctacactaacggggtgaggaggagaggaaggcagagtgccagggttcccaggggctaggatcatggttcttctcctctctaaggccagcaccacctcagctcagctctcaatttagttagacccagcaggcaagtccccctccaggcttacacaatatcagggtgaatacctggcctttgcaattgatttgacctgactttgaaatcagccttttccctggttgtagtcagttgaatagtgagtgactcccagaaagatatgtccatgtctcaactctggaacttacaaatgtggccttgtttggaaaaagggtctttgtagatgtcgttaatttaaggatcacaagatgtgagcatcctggatttagggtggaccctaaatccaataactggtgcccttaaaagagaaaggcagaggggagtttgagacaccaatgcaggggagaacaccatgtgaagacagagacagagattggaggaatgctgccatcactaaggagtgcttggagccaccagaagttggaggaagcaaggaaggattccctcctaaaagcttcagagggagcagggtcctgccgataccttgattttggacttacggtccccagaactgtgagacaagaaattgttgctgtttgaagccaccaagtttgtggtaatgtgtttcaacaaccctaggaaatgagcacacttattacctcttttcttgcaaaccaagtccaaaggggacaccagaaatgggacagagccctgaagcaagacctgggtttggttttcttttgattccgaaaataacagccctttaaggaatcaagaggttggggagaggttgaggctgaagaaagttgaagaactgaaagaatcttggctcatttggaggataagagagagttctagaatggagagaagatagacctgctctagaaaaattttctggctgggcgcaatggttcatgcctgtaatcccaacactttaggaggctgaggcaggtggatctcctgagtgcaggagttcgagaccaccctgggttacatggcaaatccccgtctctactaaaatacaaaaaattagctgggcgtggtggcgcacacctgtggtcccagctactcaggaggctgaggcacaaaaatcgcttgagccccggaggtggaggttgcaatgagctgagattgcaccactgcactccagcttgggctacagagtgagactgtgtctcaaaaaaaggaaaaaaaaaaaaaaaaggaaaattttctaatttccacaggttttcaatgagtttctgctgcagacagaatcctaaggtggctttcaagattccgtccactggcagacacgccccattgaatctccttccttgagtgtaggtaggtctgtgtatagtcaggtacacagcgggacagtacatggtgggacaattaccccctcgattgtggtctgtgacatgactcagcagtagcagactagagaggggttctcacactggctttgaagacataagctgtcactgcgagggcaccaggtgctgaggacatgaggatggcctctaggatttgacagtgacctccagccgactaccagccaaaaaacgagacctcagctctacactgccaggagctgaattctgccaatgacctggatgagttggaagcgaacctagagcctctgttgagattgcagcctcggcccacgccatgatgaggtttcttgccaggtgaacagaggactcagccaagctgggcttggacgctccacccatggagaaggtcagatgatgaatatggatcatgttgctaagtttacgatactttgttatagaacaatagaaaaggaatgcagtttctgaccaaagttcctcccaaattgtaactgaataggagcggctgagcttgagccttgattttgtgcttttttgctgatttggtggttttttatgaccaagtattaaaaatgggtgtatattttaaagtcatgttttgagacaaatcacacagttaaaaaaacaagtttaaaagtctctaaagaaaatagagaacagatgggcaaaagttgatcagtggttaaacataaatgtgttccagatgggaatggaaattgcttgcttattattgttggtgtggccagcagctcccttcagaagcctctcaggtggctttgtagcagaaaacctccagaaagacatctttccagggacgcctttccctggtgccatctagatggcagacttctagcaagttccgctagcagggcaccacagccacttctctgcagttctacaagccacagtcacaccctcttcaacaagacctggatctcagctcagggcaaggggatttctctgggtgtaccattccagtccttggggtaatggctgttattcatatctgctattcatatattctgtaaaattatctttacttcttgccagccagttcctcgtaccccgaccctattgtccttactgattatttatataaaactttccctgttcaaatcactctgtggtttctctctcctgattggacccagactgatgcactgttcccagcagcaagtagcactatgtgccaagcaccaggtgataatttcagagagctgaagtgacataggcctgtctccaaagagtaaacataatgcccacttcaacacttgagaaaagaagggagaagtataaaataaaatataaaaataaataaaaaataatgcccaagttaagcagacagagcatggggcaacagggtaagagactgggttccagacctgattctgcaactaagtatgggatttggggaggattgtcccatcgctctgtttcctcttctgtaaactacagaaagtaatggactcagaggctttctattagagtaaagctaagctgcagtaacaaagtaacaaatcacacagtggcttaaagcacgtagaagtttattttctctcaaataccagtcctcagatgaagggtccttggtgatggaactgctgtgctccacatgatcattcagggatccaggtcctgtccatcttgtcgctttgccatcatatggactttcaccctcatctgcatgggtgcagttcataggaaggtgaagagcagggaggaggccattgtcttaaggcccatacttaggagtggtgtctattacctcccctcacatgccggcaggcggtgcgcttagccacgtgaccacattgaattgcacagcaggctgcgaaatgcagtctctagctgagcagccacatgcccttgatcacatggaagaagtgagagcgtgttgagggggcaactttcaatgtccccaactcctgttccagctctgccagacccctctatgtgttgcggggcatgattgcgtgtaaactccagaccatttaggtaaagaaggaaaacatctctggcaaggtgggaaatacgtgcctcatcattctgcttttgcatttcagaatcaagatctgaagagcttgcaaaaaagttcttttagtgctgaaaagtaggaacgtggcagatgtgactaacaaaacagtccttgtgcatctgctagggagcacagattttctttttttctccaatataacaaattacaatccatctgggatttgagaagtctgagctaaggtttctggatctgtttgcatgtggaacaacgatgaaaagaagaaaatgataagtcagttttaaagaacttttcttgtgtttcaagtggaaagaaggcttgagaatttttttacattttactctggtgtagaaggacggtgatatttaaagagttagaatgagcattaaaacaaagacatgaaaataatcgaacccatcaattgtatttttatatgctggcactaagaccttaaaaataataatgtatctaattctcacaaaaatatgttaaaatgaggactatcatgtccattttaaagagacgaaatggaggcagataatttgtgtaaagtcaaacagctagtaagtcttggatctgggagttgaagttagatcatttggctcgagtctatcagagacctgcaacccttttctgtagtgcatcatatagtaaatcttttgggctttgcagacatgcagtctctgctgcaactgctcagctctgctgtgtagcatgagagcagccatagacaatatgaaaatgagtgagtgtggccgtgttccaataaaactttattaatgaacactaaaattaagttcatagaattccacatcacaaaatatttttctttttgaactttttcaactacttacaagtgtaaaaaccatttttaccttgtgggccattgtttgctgaccccgggtctatgcagttaaccttgacctttttcaacatgttaaagaggttaacccacatttaccgagggccactgacctgggcactgtgtggggcgctccatgtcctggtccacggacttgctagtccacagacttgctaccttcatctataggtagctcctgctaccgttattcacactgtatagatgaagaaagcaaagcggtcctactacaggtggaacaaggacacgcagccagccaggaactgagctgacatctgttgatggacaggaaggaaggatttgggtcagccatcaagactctctcaggacctgaggaaaagggcgggaaacttaggagcaagatgacaggagggcagatgctccgtgaggatggcaggaagaggacatgtatgcttaatattctggaaaatcctctgggataaggccaggcacagtggctcatgtctgtaattccagcactttgggaggccaaggcaatcggatcatttgaggtcaggagttcaagaccagcctgggcaacatggtgaaatctcatctctactaaaaatacaaaaattagctgggtatggtggcgttcacctataatcccagctacttgggaggctgagacaggagaatcacttgagcccgggaggcagaggttgcagtgagcaaagatcacactactgcactccagccttggtgacagagtgagattctgtctaaaaaaagaaaaaaaactattcaaaatcctccaggataaaactctctgttgaaggaagctttaatcagcagcgagcacatcaggcacactcgttgctgccccttctcatcccgcattccctctgctttggtcaggtggtgccctccttccatgggtagagccagagatggtgggttctggctggtcagatgggagtggacagagacccggggtcctcccggcttcatgactgcacgtggtgggccctgcactgtgtgtctactgggatggatcaaggtgcaaccagagaaaccttgagccctctccagatacttgagtggtagctgagttcctgcagcctctgtgagctcccttctgagcctctggctcccagtttcccagtaccctttctgtattagcttcctggggctgccccgacaaagtatcacaaactcaggggcttccgcaacagagatttattctctcacagtcctggaggctagaaatttttggacttctagcttcccggacttgattggcagggccacacttccttctaaggctctggctgggggtgggggtccttcctgcttctgccagcttctggtgatgctgacaatccctggcattccttggcgtgtgggtgcattactccaatctctgcctccctcttcacatggtcttctctgtgcgtacgactgtgcatcctctcctctcgtaaagggcagcagtcgttggatttagagctcaccctactgtggtatgatctcatcttaatgacatctgcaacagccctgtttccaaatagggccacattctgaggttctgggtggacatgaattttggggtgggaaacactcttcaagccagtaaatcttcctccccaaatcttgctaggtttccaatgcctaaaagaagtgctaattggagaaaataagaatagttttctacttatctcaggagcgggaaaagatggcaaaatggcatggccaattttggaaagaatatatagggtgttgtaaagatatgtgatgatgatgaggatgatgttttcaccaatatttgcagcctcttgtccacacagaaggattaggaagattaatgccttcgaaatcagctatattttagcactctgtttttagtgttttcatgattatcctggtgtccttgtttttgaggtggctgctataattatggtaacgtgtgtgagtaggttagaaagatgttacaagtgattaagctataaattagtcactttggagtgtgtaatagttctttcaagtccccagcatataagggaaagtgacactggtctacaatgactgtctccatgcttccatgcagaaattgagacctggagaatgtaaagacttgcccaagttctgtgagtgagtcagtgctagaaaaatcttgagcccagccccccagatgtgatgactattctctttcaaatatttctacaggattagaatgggcgctcaggcttggctcagacaccccacatctttaggtgagtggcttttaaattgccatttggtcacgcctacttggcagagttgcaaacacgggctgcagagttcacacccgcaccctcctctctggaagtggagtgagaacagggtgggcagaggtggggctgccacacctgcttccctggaaacccgagggagagcacaggacgccaggctgggactcggctggcagctgcttcgggcgtctcaccttgtgactatttcctgggcactgtgggagaggaggcctcttgcctgagctcctgtccctactgtctcctctcactaaatgcacggcacggctttgcggtaataggctgggacatgtcaactcttttttttttctgagacggagtttctcttgttgtccaggctggagtgcaatggcacgatctcggctcacgcaacctctgcctcctgaattcaagcaattttcctgcctcagcctcccaagtagctgagattacaggcatgcgccaccacgcctggctaattttgtctttttagcagagacggggtttctccatgttggtcaggatggtcttgaacccccaacctcaggtgatccgcctgcctcgacctcccaaagtgctgggattacaggcatgagccactgtgcccagccaacatgtcaactctttaggagagtttgaagacaaaaaataacccatgtctgagcatgggaggtgctaaaaataggaacttcttagcttccacaagggcagataaatgaataaataggccataaaccaatgtagttatttcagctgggggattttattttcttttgattgtcccctggagctacgaaatacacaaatatagactgatagatttttttcattaattcgaaaagcatttaatggctgtcatctatgtgccaggcaattgatgcgcagccagacttccaggaggctggagggggatccagatgaacctcccggagtaggattgtcaggaggggactggagaccagggccatcctgaaaaccccatctctgttccaggaaattcctaggatcccctgggaggcacagcctggagaatcctattttggttgctgaacagatgcacacattggaattgagactgcgtgtgcttggggtgggtcggtgaggcgggggcagtggggtccaggtgggagccgtatggaagccctcccctccccatcctccaggcatgccagcgagtgtggccttatgttgagtgtgtcctccagtgtgagtggctcctccgagtgtggtccaaggacccgcagcatcagcatcccctgggagagccttggaaatgcagaatcttgggatccagctcagacccagtcagaatcagatttccaggcagctcgtgtgctcattgatgtctgagaggatctgcttgagaactccacagctggggctgacaaatccccctctgacctcaaatttacctcctccttctaaaaaagccagacaacctagctccctgcccacccacagctctttccagtggatccaacttcctctcacacccagtttgagcagggggagacaggaagggcctcttctctgcttccagatcgtctgtttcttccgtcaaacaccacagttcctatgaaacccaccgcagtagcagacctgggtcttgtcaagagctatgaagggtctgagattttacctactcctaggctaaaagttagcctgccagtttgacaaatgctgcctaatgacacgagactcccggggcagagacaaaggactttgctactcacagcacagcaagcagcataagttttgctttaaaatgtggtgtattaatgcaatatttgagttatagtaaggccaacagatcaggaaatgattgtcattgaaaggacagtttgttactcccagttcccaggaggaggggccacgctgagctatgcagggccacgagcgttgttagcaggctcaggagacagcggacatgtgggcaaaagccttgtttgtgtccctagttgtccggtacttgctcccagggtgattaggcaggtggatagtggcctggagtgtgaaaacccaatagaggaggtgtctggggcatgggcttgcaactggttggtttgcatttgaaaagcatgtttgcaggagcctggtttactatctctggggattggttagtactgggtggggcagtccctccagggtcagcaaggtcccagatatcaaagcatcagaatgcagagaatggaagacatggttaatacaagcttaatgtttgcactggttccctatgtccccaaaaccccatgggggtgacgtggggggcccaggtggatgctgccgcgcagtgaatttgcatcagcgagggaaaaccctgagctcaggggatgcagatgctttataatgggcagtaagcaaacacacctaacctttgtcccagcgggagatgttatctttataatattaggtaataaccaaacctgctctctgctctgtagggagacaccacctctttgcttctccaaggctgtttgctgcatctgaaaagacaatctggaacaagaggagagtcaggccagccacagtggttcatgcctataatcccagcactttgggaggccgaggcaggtgaatcacttgaggtcaggagttcgagaccagcctggccaacatggggaaaccctgtctctactaaaaatacaaaaatcagccgggtgtgatggttgcacctgtaatcccagctactcgggaggctgaggcaggagaatcgcttaaacccaggaggtggagattgcagtgagccaagatcatgccactgcactccagcctggtgacagacgagactccgtcaaaaaaaaaaaaaaaaggttaaaatgctacactttcttatcatagtttaccgcaattaaaaatcaaaacaaaacaaaacgaaaaccgtaaaagataaaccttttcgaatgctactatttcctgtatcataaacagttcctcttaggaaggcctttctggtatattaaagacctgctccagaaaacacaaagcggatcagaaaaacaaaaagtggatgtcactcatggacattttgataacatcaatgtcatgtacatttctttcccataaattctggggaatttttaagtggcatgtggggctctgaaaggttaggagagatcaggttttaggggagtggggaactctgatgtaatggtctaatggcccaacaaacttgggtgccagggctctggcatgagggcagagaaagggctcttggaactggggtcctggtgggaaggggagggatggacacggtagtgggtagaataatttcccctcaaatttcaggtcaactcggaatctgtcaatgtgaccttactcgaaagttctgtctttgcagttgcaatcagtgaagaatcatgagataaaataatcttggatttaaggtgggccctgaatccaatgactcttgtccttatatgaagagaaggatgacaacacggagtcactctgaaagctcagcgtggtagaacttagcagcatgatccagctgtgaggaagcagcttccaggtgtgctgccagctgctgacctagggggttcaccaagagggcccctccctgcccagtgccctgactctggggtccagggctgcacacttggatgacagaaggacatgcccaagcttacctggctgctcagagaatataaccagacagtcagcactgactactcacatgctcatgtttattaagagactctgactggtgggaatggagtcatcagagccaaaagcacgtgtgcaaaagaaaatgagcgttttcaccttttaagcgaagattgtttgggggttgagagaatgctggagcctgcgctaactccctgggccagcacaactgcgacgtgtcctctgcaggggtctccagcctggtgctcccagcgagataaaccagggattacgtctagagggtcagagcatctgcacctgtctagacagaggctctaaactggggcagtggggtgaggttggaaagcagcagatgggatagatacacggagttggagggagtcttctatttaggggtatctcagcagacattctcagctgccaaacagccagccccaggcatttccctgttgcagaggtgggtgcccgtgctatccaatgattccctcggctgacagacagggatggggtgaagaaatagcaggagaagatgagaaggaaagggtgagtgaaacagaggaggtgggggaggaaagaaaatgtaaatgacacacaaaatgctctgagatgcttactggatgccagacactgtcctgaatgtttcgcgggcactgagtcctcctgacaagcccatgagggagagcttttatttcctccattttccagaggtggaggctgaggcagggaggtgggttatggcctttctgcgagcattcgcaaacattcaccgaaacacagtatgttcaccaacatagagttcaaaagccacactgagaatctgcgtggtccatcaataacgtgttgggcatgttctatgatctgaaatccactaggaccctgggctaccaggcccaatgtctctctggagtgtctacagcctagccaggggaaagagagatgctaactataacaatgacatgggataatgttgttgtccaggtgcagacactcaagtattgggaggaaacaaaaggactggaaattgagcccaggcgtttgagaccagcttgggcaacattagtgagaccccccccaacccaccgctctctacaaaaattaaaaaattagctgagcgtggtgctgcatgcctgtagtcccagctacttgggaggccgaggtgagcagaccgcttgagcccaggagtttaagaccagcctgggcaacatggcgaaaccttgtctctacaaaaaatacaaaacattagccaggcatggtagtgcatgcctgtagtcctagtgactcaggaggctgaggtgggatgatcgcctgagcctaggagaacaaggctgcagtgagccgtgattgcaccactgcactccagcctggacgacagagtgagaccctgtctcaaaaacgaacaaccaccaaagaactggaagagtcctgcaggcacttgggattgctcagcaagcacccgggagagcttcacaggggtctggaatagtccagcaggtgcatgaaagaaccccggctatatctgtaccttggaagagtcaagtgcaggagctaaatttccatgggaagaggtgagggacatggagttagattggaaaggtctctgaatggcaataaggagaatgatatcctgtgacccaacatggctgctatccgaagatttccaaagtggaaatgtgttaggactttttccgttgcaaaagatagaaatcaaattcaaacaactagactgaaaagggaatgtgttaggactctggggagctctaagaaccgtagtgactgcagggacatcaggaagaataacgtggcttgcgaatggagccgagacaccctgtggctccccctttgatctaggtttctctgtgcctggtgtcattcctcccctgcaggtgggcattctccatgtggcaggcaacctctgtgtggcagaaaaattctacagggcagggtaccgggaggcaggtacttccatagggcaggctgccatgagccagcacctccagatagcagtacttctctgacatcattgcaggttagagatccctgaaaaacaatttctcagccttgattttaaaaaccccaaggaaggagggattctgattggtctagtttcagtcacgtgtcaacagcagaccaatcaactgtggccaggggcacagatgctttacagaggcaggcctgtgtcgtgtgaccaccacatgacctgcgtcatgtgatgggtggaggagagggtgggcatgctgtgattggcagcctccttcccgtgggtggagaccttttataaagggaagggaagagcgccatgtggataaacagatgttcaccgcaggaagggcccgaatcagatgggttttagagattactgggaaggcagccccagggatggtgggtctgaagctccgtgatcagccgcagaaatatttctcaactttgctcaacacaagcgcacttaccccacccctagataagaaaaacaagccaagcctttttagaatgttatctgaaattcaaaatagattaagtctcaggaagataaataaaccaaatgagcactgcttggcttctaaaccacacgcccatcccctggggaggcaggcagcccacactcctgccagaagagaaaagaccagctcttgaatggaatgaacagttgcattggtgggaggggaacaggcactggagttgattctccacgtgcttctcgctgtcatgggcccaggactgccgggcatctggtaaacatgcagattctgatgcagaagggccaaggctgggcctgagggtctgcttttccaacaagcttccaggtcgcggggtggggggggggggttgctgctggccctggcaccccactttgaaggagtgaagacttacggcctagcacctgcagatttgaatgagatattggcgaagagctgcgagctagccctcaaggaagccacccaggtggccagcgctggtggttccatctcagatggagctgggcatgactgggccaggcagatgtgtgggccttggccaagcctgggccggcccctgctctgggctgctcacacccatccctggccacacggaaaacttgtgtcagagccagcagggaaaggagtgaacttgctctcacttcacacttggatcagagcccgaggacctcagtggcggcccccttggggtacctgtgggggctgaaagagacagagcaggcttcctccaggccccccgggcagctttacccggcaacaagaatgggtgtcctaagccaacccctctctgtaggtagaataatggcctccaaacataacaggttttaatctctggaaactgtaattgttactttacgcggcaaacactttgcaggtgtgattaaattaaggcacttgagatgaggggattattctggtgaagagggacgcagggggacatttgacacagaagaggggaagcgatatcaccatggaggcagaggttacaggggtgctgccctgagtcgtggaagctggaagaggaaggaacagattcttcccagagcctccgatgggagggcggccgtccagcaccttgatgtcactgcctctggcttctaggactgtgtggaatagacttctgctgtgttcagcctccctgtgtgtggcagtttgttcccgcagccacgggaagtgcatgcaccacccccccgccgggtgctggggagacgtggaggtcttggggggcgtcccagggggctctgcttctctgctgtctcttcagaggagggcttctcttcgggctgttgggaaggggctttggggtgtctgcatctgttgaaatgggggctccgcgtggggcagcagagccccaaggtcgggagggtgttcaaggctgagcgcagcagctgcacaggaaagaacgcaggaggttgagcctgcgcctcccggagggagggccaaggaggagcagggaggtctgtgcccaaggatccgccaagccgcagcaggctgtccccactcactcctctctaaccaccctcatgccctggcctaggacctgacctcctccatggctgtggcccagcccactgctgccccagtgattcccgcatagtcagctgcgggcaggactaggggcctccctcccctccagggtcttccctgggacaccagcctgctccttgcagagtgaatgaaaggccttgttaactcaggccttctgcatcctaccgccaggagcgtgctcagtgcgcactggggagagacgaggggaagggaaaaaagcacaataggccgggcgaggtagctcatgccggtaatcccagcattttgggaggctgaggcgggcggatcccttgaggttgggagttcgagaccagcctggccaacatggtgaaaccccgtctctactaaaaatacaaaaattagctgggcgtggtggtgggcacctgtaatcccagctactcaggaggctgaggcaggagaatcgcttgaaccagggaggcggaggttgcagtgagctgagatggtgccactgcactccagcctgggcaacaagagcaagactctatctcaaacaaacaaacaaacaaaaaaaccaaagaaacaaacaaaaaacccaaaaaaaacacaacaaaaaagcacagtaattatattttaaaatcttctgggatacaacagattagatttccaagaaagggtttgtttgaatgactcattgtgcagataaaaatagttcttcagggtggggtgtggtggctcaagcctgtaatctcagcactttggaagggctacgtgggtggatcaccagaggtcaggagttcaagaccagcctggccaacatggtgaaaccccgtctctactaaaaacacaaaaattagctgggtgtggtggcgggcacttgtagtcccagctacttgggaggctgaggcaggataatcacttgaacccgggaagcagaggttacagttagcccagatcacaccattgcactccagcctgggcagcagagtgagactctgtctcaaaaaacaaaacaaaacaaaacaaaacaaaaaccctcaggtggagtgaatgagcctaattaatattccagaaacaattttgacaaaggtggcattacagattgaactttgtgtctccccagaaaaatacgttgaggtcccaacccccagtatctcaggcagtggccttatttggaaacaggtgttgcagatgtaaatagttaagatgaggtcctaccagacgacagtgggcccctaatccatgatgactgctgtccttacaggaagacagccaggtgacgatagagacacaggaagaatgccgcataacagcaacagaaacggagattagggggatgcagctggaagcccagggatgatgaggattgccagcaacccacagaggcgaggatgaggcaaggaggaatttgccctacaggtttcagaggggacaagccctatgcacaccttgatcttgaacttctggtctccagaactgtgagacagtaagtttccattgtttaagccccgatctgtcatactttgttagtgcagcccaagcaaactgataggggcgatgtctgccccttctttgctctgccctctgccacctgccatggcagccccccatggccccttctcaggtggtgacccccttctccttggtggcaccctcaataatcccctatcctgtgtctgaaaatgggcaatcacctttattaaagaaatgaggcttttctcactccccggccatcttagcggctgctcttggttggggtccgtcctgcagctaaggcgggaatttggtggctgcaaagaagaagaaaaagctcctggagtcgatcaactgtaggttccaactcattatgaaaagtggaaagtatgagctggggtacaagcagactctgaagatgattagacaaggcaaagcaaaattgatcattctcactaacaaccacccagctatggaatgttggccaaaactggtgtccatcactacggtggcaataatattgaactgggcacagcatgcggaaaatattacagagtgggcacaccggctatcattgatctaggtgattctgacatcattagaagcatgccagaacagattggtgaaaagcaaaccatgcaaaattttcctttaataaaatttgcctgagcttgttaagaaaaagaaagagagagagacagagagagagagaaagaaagaagaaagaaagaaagaaaagaaggaaagaaagaaagaaagacgagggagggaggggaaggaaggaaggaggtgggagttggatgcaaggaatgcgaccctcagggacccgcttcgaacagcccatcagacccacttttgcccttcaaaggaggttgagaagctccactctgttgtccatgcagctattcctgctcaagctgcagctgggacttttataagaaactgccttttagagccgggtgacatcccacatgaagaaaccagggccggtgcagtggcccatgcctgtaatcccagcactttgggaggccgaggtgggaggatcacttgaatctaggagtttgagaccagcctgggcggcatagtgagacctcgtctctacaaaaaataaataataaaaaaattagctgggcatggtggcacatgcctatagtcccagttacttgggaaactgaggtgggaggatggcttgagcctgggacgtggaggctgcagtgagccatgatcatgccactgcactccaggggggtgacagagcgagaccactgtctcaaaataaataaacaaggagtgccacttattgtcacatttggatttgtttctaacatcgtgctgagtttggtcacccacctcaatcacctgatgtgacttgaaaccacttctggctatttccaaaaatcagctccgcactgggaggggttagggctgccctttaaggaaacattaaaagctcagtatcttcctttggtggctccttcaggggcgctagcttctgactcatcagcatcattttagctctctgagggttcagaaatagaggaaacagcacttccttttggtgaacgcctttgtattattttattttttcaccatgatactgaaactagctcatcctgggagagtcaaaggaagctcatatgttttccctgagctgggctaaattcctgattcttctaataggaaagatccaaaacttcccacggagtttcccctcgtctgcactgagtcacatacctgtgggcttcgagctaacagaccttttttaatcaaagagaagatgaaaaaggcaccttgcttctgtcccatttttagatcttttttagccccatttcttctctttccttcctccatttttgggtttgtttggtttcacgcctgaattaaatgttaacaggaggagcaagttttatacattgcctgaagtcatcattgtcagagaaacaaatgcaatctttagtgaggctagcaatggtgggaagaagacgcgtgggttacagcaagcacagttactaaagctttttgcattgagtagctgtggggtccagggctccatctctctggccctcacttgctcatgagcaaatagaggcttcaggttgtagcaggttgtctcaaactagggacgtatattcaacaaacctgcaccttattcaaatgtagattctgatccttaggttctgggtggggcctgagatcctgcacctctaacaagctcccagatgacaagcatccaagatcacacttttcctagctctggatcacacttttcctagctcctagcagaatctcaggctcatcccagcctcttgagccagaattcaaattttcacaagagccccgattcgttcagatgtgcattaaagtgtgagaagcccacactggatcactgagggaggtcgcagttgcacctggggaaccaggaaccgtggaggcatgagcccatcctggagaccctgatttagttggtggggagtggcctggacatcgattgctgcctattcacagtggttcttgattttgctgccattaacatcacctggggagctctgaaaggcgtccccgtgatgttaataggcagcaagatcgggaactactaggctgcgggttcctcaggttctaatctatgatgtcattggctttatcagggcaatttttcctggccacattaggcaggagaggtgcctgtgcatctcagaagtgtctatggaactctgcttctgaacttcccagcacgctcaaaacaggacctggtttacagcaaagggccagctcctggcaacatcatgaaacaaacgtacactatcctctacccagggttcccttcagcctataggtgcccgacggcccctgctctgtgctccatcctgacatcaggaaacccacgaatgggagaaaatctcatgtcacctgtttacaggtgagtgaacatttaagtcaatgggttgctctctcctggggagctctaattgtagaatttaagagggcagagtgaagccagtgggagtcctgccaggtttgagtcacagcttggccacttatgagtccctctcattaccccaccagagcccggcgtcctgatgcataacacccaccacccggcttagggagggctgacagagtgaattactgacagaggatggcccttggccatttctgcttccttcactttcccatcactgccttagaatctggagagactcatgctggcttcacctggacaggcatcctgacacgcaagcgaggattgctcccaccaattttctgcgagagaaacaggggttcggttgattcctggcaacacgttcgtgtggggatgcacgtgggggtgcagagctggacttgggagatgcttcagctgatagcacacttttcctttggggagttttcttcctgctgttataacacctgtctccaaacaaagccttcattggtcaacagtgaatgattcatttattctgtgcatagacctatggcgtgagatgcatttggaaaccttgagaacagcggttcccaaccttggtgcttggagtaatgtccgaggacatttttggttgtcacaactggggcagggaactgttgctggcgtctagtgggtggggtccaggggtactgctaaacgtcctgcagggcagaggctagtgccaccgcagagaatgatccagtgcaaatgtcgctggtgctgagaatcctacttcagacccagggcaagactgattgcatgtgttcatttatatctgctcttgtagtcattcagtcaagaaatgagcaccttgaatgactattaaatcaagacaggttgggtgtggtggctcacacctgcaatcccagcactttgggaggccgaggcaggtggatcacttgaggttaggagtttgagaccaccctggccaacatggcgaaaccctgtctctactaaaaatacaaaaattagcagggcatggtggtgcatgcttgtgatcccagctaattggaaggctggcgcacgataatcacttgaacctgggaggaagaggttgcaatgagcagagattgcaccgctgtactccagggtgacagagcaagactgtctaaaaaaaatcaagacagatctctgagactccacaggtcaatggaagatgaacagaggggcggtggggctgccccccacccatgtgggaggcatgggcaatgcctaggttgaccagctgcccatgctctgaggcagtagtctcagggcagggtgtgcaccctcccaggcagggcagcactcacttatggtacagaaggaatcttagagcttcccttactcaggaatgaaatgagctctagcccctgccatcaccttttgctcaacactcacccactccaggcttcaaaaggaggctgcccacatggacagctcagagggactccagggcacgtggttgatggagaagccagatgcagagtggttcacttgggggtgcagttcaggaagccacggggtgggtgtgagggtgtagtggagcgtatcagtgcaaggataccctgagactgggggtgacattgactccacaggcacgggaaggagcttggaaacagactgaactcagaacatgcatgtcacgaggggaggggctggaggcttggggttgggagaggctgcctccactgctgagggcacaacttcctggttcagccccggcaggcctgcagatccccctgcatcctttccctgaagatgggccatctgtgcctagacaggttggcatgtgtattagattcttagggctgccacagcaaagaaccacagactggggggcttaaataacacaagtgtattttctcacagtctaggaggctggaattgcaaggagctcagggtgtcagcagggctggtttctcctgaggcccctctccttggcttgcaggtggccgccttcccatggtgtcctcacatggcctctcctctgatgtgccttcctcttcttagaaggataccagtcctattggattagggtctgccctaaataactcattaggacataattacctctttaaagatcttaactccaaatatagttttattccggggttctgggggttagagcttcaacatgttgattttgggggacacacttcatcccataacagtgtgggctgccattctccactggccctctatcctggagacacacctcctagagagtttcctacaacatgcaggacatctagttaaatttgattaaattgtatttcaaatgctgcatgggatacacttacccaaaaaattatcattgatctgaaatttacatttaacccagcattctatatttctagctgctgagtctggcacctctacccactgggaaacctcctactcatggctccttacctgggctgccttggtctgggacggacacagaaaggtggagggtggaattggtgtctggaggagcagctggtatctgggaatccatcaagggccctggcctcatggctctttcaggacaacctatagaagccactgagatgctggggtggcctgtggtttgatagaaaccgcagcatctatttaggtgaatcctggaggtacttcctgtttctcttccagttttcacatctctgtagaatgggaaatgtcacacaataacgaaccactaacaaatgatccaatttccagttgcagaaaacacatgacgtcatgcacatcatggtgttgaaaatatgggtgcccaatcccttacccacaattctgaaatccaaaacactctgggaacattttttatgtgtaaatttgaagacaaaacccatttggggataaaattgatttgaatggacttgggactatttatagactttctttatccattggtgagaatagtgatactgtgttttctggggggcactgtccagacatgtggggggttgtaggagattggtcagggtggtgggaaaaattgtagaaagaatgcaaaccttcctggaaggccaggaggttttacaaaagctttggaaaaggatttgggctgaaggcagccagattctcttatctggtacctgaaagcttaggttagataacaaggggatgtaaagaaactgatctagataagttagtttacttaggcctcggaacctggcctttaatcgcctgtgtgcaggactgctctctctgggggagtgaccatgtaaattacccacaagtgtgttgactcaaggcctttgtcattaaatctgtactaaataaatgcccgcagtgccagcttgtcagggccgtggctgctgactctttacagcaccctcctcagtgtctgtgagcggcctggtcccctagcccactctttcactggatacctgtgtctgagtgcatgtgttcatctgttgttcggccaggatctgcaggccagacccagcagtgggtagtaagtgatattcaggatatgtcctgtattaccagcctacagctccccaaactcgaatgccaaaaacccacagctttctggataaatgattgtgcagctacaacagcagacaggcaccgagctcttaaactgtgggaggcacaatgctaaatgctttaggtttcttatctctttaatcctcataatctgcaaaatggatacttttatttgcatttttggtaagctgtttttgtgttgaagtatgacatgcccacagaaaagcccacgaatcaggtgcccagctggaagaattattagaaagtgagtccacacccatgacaccacccagcgccatctctcagcagcgccccagaggctcccaccacagcctgccgccatcattacctcccagattctcactttcatcaccaaagattcattctgcctagaaaaaaaaaatgctgtcatttattgagcagttattatgtgccaggaacttatattatttctcacattgactctatcagggtgagtattctattttttttttttttttgagatggagttt

SEQ ID NO: 351 - DNA, 81095 bp, Homo sapiens
cgttactgaaaatagtttatgatttattgctgttcttttttcctcagggtaactgtattagtccattttcacactgttatgaagatactacctgagactggataaattacaaacaaaggaggtttaattgattcacagttctgcatggctcaggaggcctcaggaaacttacagtcatggcagaagaggaagcaggcaccttcttcacatggccacaggagagcaaatgagaggggggaagtgctagacacttatcaaacaaccaaatcttgtgagaactcactcactatcaggagaacagcatgggggaaaccatccctataatccaatcacctcccaccacatccctccctcaacacctgcgaattacaatttggattacaattcaagatgagatttggatggggacaaagagccaatccatatcagtaactcaatcaggcatgtacaatcaaattattatttttaaaagtctcttggaatagctcctctcagtttggtcacgctactctaagacagaggttcatttgttttattttacttctaattttgcgaggttgctttttaaaatttcactttgttttacgattatgtaaagcgtttccatggctccacagtcaaatccacaaaatatatattcaaagaagtctaggtcctgtccccaaccctctactctattctgcctacccctttttaggtaatcatttcttaagtgttttttcttccattgttttattttaattatatagtcctacctcctccttaaataaagagtagcatgatatatatacttttctccatcttgcttttccccccaaaccttgaagaatgcagaggctataagtgccaaccttcacgcggtcaaaaatccaagtaaaactttttagtctgcagaaatgtaactactgtaactactaatagcctactgttgcctggaagccttactgacaacataaatagtagattaacacatattttctaggttatatgtattatatactatattcttacaatagcaagctggagaaaagaaacttattaagaaaatcataaggaagagaaaatgtacttactatttcttaaatggaagtgaattgtcataaaggtcttaacctttgtcatcttcatgttgattagtctgaaaaaaagggttggtcttgctgtttcaggggtggcagaggtggaaaaaagtccttgtataagcagactggcgcagtacaaactggtgttgttcaagagtcaactgtagtgatatatcctggaaatcactgcattctagtgtatagaagtagtcttcaattctttcaacagttgccaagtactttattatgttgatgtaccatggtgtattccatcagtcctttattgatggatatttgggttggttccagtctttagctgttacagagtgctgtgatgaatagtcttgtgcatactattatcttatttttaaaatttttgctagtgtatctttgggatagagtcccaaaagtagaattgctaaatccaagggaaaatgcatatgaaatgtgctggatattgacaaatcccactccaaaggcattgtgctgagtattcagttatttttttctcgtttctatacttcccattttatcctctgttctgtgaaagggccgtatgtgcaaaatgacctccaaacattaaaggagtcaagcaagaaaagaccaaggcaaatataataaatccagtttatcagtctggggtgttttattgggggagcttacagatagaagcatggtcttgggcagctgcaagataggtagatctctacaatgttactccccagacccaaggcttctataccataggggaagggcatatgtacaccagcaagataattaaaggcactttccagaacaggcaagaatgctatgtgcataagagctataatttgtgcaataacatcaaggttggcttgttctttcactagggacagtacataaagtggaaaccaggaggaattcacgggactgggattaatcagacgttagcatggcagatcagcatcaaagatggagttacttttgtctccacaccctccactttgagaagctggggccaggactctacacatatttctgctttactagctggctccctatcgagtttttccaaaagcatgcaaaatgtagactgaacagcaggaaaaagaatgaccaggagactggctgctttctgctttgtttcctcttcctgccagcatcacccaagccacagtttttcacccagtaggggtaggttacagtttccaattttctacattcctagaaccttctcagtatccacaccagccagtcagcagcccagctcagaagtctgagcctctgctctgtgggggcccccggggctcctgtatgtccaggtggtttcccttccttggaggtctgggcccagcctcatggggttctttctcctaaccaagcagaaagcactcccttttcagaattctgggtcccagctcagaagggctcctcttccaagtttctatattctaataatcccaaccttcttcctttgtttccccaacctttaaggataattaataatccattgctttcgatggcaaaaacttcaatgacttttgcaccaatataacacttcctaaagttaccacatctggtatacttcagagtttactttatctttcagactcttcaatacctgattaacaattctgtttctattaaattaaatcatatgagtgctatttggctaacagagggattgtaccattttatctttatttttacccataatttatgagaatgcttgttctctcaaccttgcctgctaaaccttatgatttgtgctaatctaataggtaggaatagtctttcagtgtagtttgagtgtgcatttttcttttcttctttttattttttgagatagggtcttgctctgtcacccaggctggagtgcagcggagtgatcatagctcactgcaagctcaaattcctgggctcaagcgatctcctgcctcagcctccccagtagttgggactacaggcatgcaccaccatgcttgccattttttttttccaatataaatgaggtcttgctatgttgctcaggttggtctcgaactcctggcctcaggtgatcctcccaccttggcctcctaaactgcatttttcttactttgagtctacttgagaatcatttcaaatgagggtctatttgtttgcttgtctattttttctgagaactctctgacccatctttccatagccctgctggccttttattttctctatttttaatgctttttctgcattagctataccaatctatggttaccatataaattctaaatattttcccacaaggacaagctgttgtctatttactttgctaacagaggtttttgttcccatgcaaaggtttatcatatttatatgatcaaaagtatcaaggtttttccccattgcttcaagaagttgaatcaaaattaggaaagttctctccactcggattatagaggaataaacccatgttaccttttaattaagtatattgtttcatcttaatctttacatttctgaaacgtggaatttatcctattgtaaagcataaagaaaatgtcatctatgttacttctctgggcaggtccctgaagaccctctctgcttgcttatgaccccagcaagtcctctaaggccacagcatgctggctgagagcatactaccccaagccacggccctggtccaagctgtgggcatctgggctcactaagacaagacagttgaacagctccaagaaagggtctgaaatttggcttttgtgaaactgttaagcacaaaagttttgagggaatattcaaaacatctcctactttcaggttgtcaggattatttctaggaactgagcttttctgatgtaggcatctgatgcctcacctacgtcttgtatttgcacatttataaatagggtctaagagacgatgtatatatatatagcctccaaggtcagagatagtttcaaaactgggatgcactccacactgccttgctccaaagctgcaaaaaggcaagatctcaggcgttactaagagctctaattatgctgggttcttataatttaagaattcaagagttataaagtataaattccaatagcaagtttaaaccagacaagaagcactgaaaattttaaaacaaatacataaaattacattgcctaaagagagaaaaccaaccacctctcagtcatcagtagccatgcaggtctcaggaagcaggctctatgggatcgcttgtcctaactccagaatgggaagaaactgtcagatgggaaaaatgttgtttagtcaatttgcattggtcataaattgagtgatttcattgttgtgattatatacatgacttgcacttgtctgaaatagcattgaccaatataatttcacttgtatggggttacataacctaacatttaggtgctaaattataatagctttgctcatttagaatgataaaataaaggtactcctaagagctgcccattgttatctaacaaaatactgcacctatcatttttacctcagaagacactagattaaccttttcctcctcttctggagtacattttaaaacgtagaacttttggggattaccaaagatgagagaataaaatttttgaaaaatggttcgtatttgattttctgtcacaaacacagtctgtagcttggctctctttttgttagtgacctctaagtgaatgacttcttgaacatgcatttcctccccctttgttccttctttaaagaaagaaaggcctgttataacagcaacgaataatctaatgggatcctgctggcactccccactgctccttgtctttccttctttcatatgtgtgttgtcacacacaagtctaatgtatacagctcagacatattaagagacacccccaccctgcctgcccccaattaagttgccaacccagcacctcactcccagccaccgaagaagagattgcctgttacatcactcaagcccattattctcttttctccctatggcatccactccttctagatgctttttagctcctggtttaagcagaggcaagacatattttgcattttaagattaatattatatatctttgacttttacaaggctagacaccctggggactgacatttaatagatgttaatggaatttaatttttacatgcactaggtgtgagcatttatcttctaaaatagtctgaaaccttagacggcaccaagaaaattccataacaaattatttttcactctatatccttaaatcaagttactgagcaaagtagaaaagctgttttctgatatttagaatttaaaacctgaatataattatcattaattaattacatggaaaggatcaacaggcattttgccatagtgattaccattgcaaaacagttctaaaatggtgcctaaaaagaaactttctccataacctattttcccattgattttcattaggcaagacatcccctctgcaaaagtaagtgtggccccaaacatattaaataataatcagcatgatcaatattttgaaaatttttatataactctaacaaagcaatgataaaagtaacacaaaattagaggtagttgaccatgttttctgagtaaattgtgtgttctaacgctgtgactaggagcagagtagccacttgcattttcaaagtacatttttgtctggatttcaaatacagtttaattttgaattttggctaatatgatcacagaatttggaaaatattacagatagaagaaaacactgctttgtatctttgtaatctttacaattcatgaactaacatatttgaaaaagctgtcaatttattctctacatatttaaaatgctgaagtccctcccattccaattaatgaaggaaaacccttctttttttgcttcagtgcctggcactgaagtgcctacttaataaacatttgatgagtaaatgaatgattttgacagtagccaagagcttgcagcaaaaatgaggtaatgcagtacattgcaaagagcaatgtgaggaagcggatctgggttcttgtcccagttctgtcatgaaccagctgtgtaactttaggtaaggaacttgacctctctgggccttggcttcctccatgcaaatctggatgctgggtatgacctccaatgacctctagttctaaaaggctacagttctaaatcttaaaattagccattcttgccagtgtcactttgaactttagccattagtctccacagagatagacacattttagcgtagtagcctctagaatgaaatctattaaaaggttcaatatgctaatgcaagcagtggaaagatacaagcctcaatggttcacccaaagaggactcgagtaagtgtagaagtgtacaagagaaatagaagggaaacctgggaaaaaaaagtctctatagctcagactagtgaagtctccagaaagcaggtttcctgagaggtcaaaagtgagtaggttttatttatgactgattaacaagtgatgaatttataaagggcttcccttccaaagagagcaccagaatgctttatttcctaattggagagtgctttgcacataaataaaggaggatcgctgctgcctgtcagggaagcactttgatagggcaagcatgttctcgtctgtgtcctgattgactgtgtgaccttgggcaagtcattcgtcttcccccaaccagtatccctaatcgtaaaacggaaataaaaatactcactgccttcgctgaggatttataagacaagatgaatatgtttaagcccccagaggggaaaaggccacatataagaaggcaaagaactacagactcgtgctgttggacttttcatacaacttgggaaagaaaacaacacaacaaaactcttgagctataggccgggcgcggtggctcatgcctgttatcccagcactttgggaggcagaggcgggcggatcacctgaggtcaggagttccagaccagcctggataacatgacgaaatcccgtttctactaaaaatacaaaaattagctgggcgtggtggcaggcgcctgtagtcccagttactcaggaggctgaggcaggagaattgcttgaacccaggaggcgaaggtggtagtgagccgagatcatgccactgcactccagcctgggcgacaaagtgagactctgttaaaaagaaaaaaaaaaaaaaaaaagaaaagaaaagaaaagaaaaaaagaaagaaagaaagaaagaaaaaaagacaaaaaaactcctgagctttaagttttccagtcccaaaacaaacaaacaaaaaacccccaaacaaacaaaaatcctcaccccatacaacctgcccattttttccccctacatgttgcacagcacagcacaggctggggactgtgattcgaaggtgagtagctggacggctgaaggctgatgttaaatttatccccccagaattcgaaccccttgctccatccgtaacagtgagatcgttggcaaattagttttgatgtctcaatctcttcttctgtaagatatgggataatattactatttaccatatgtgtacagatctgtgaatagatgcctggcatacagtaatttcccaataaatatttgctgataatttctgtttcttagcagcatcattcaaactgctgaaatattttctttaaaaaaaaatcaaaggtccttctgagatagtattgggatataaagataaacgtgacaaaaacatttgtgcttcaaaggggaaccagtataaagccataaagcccactttcttctgctgaatagaatgagtttggggacagggacaacgccttaaaatgggtcaacgcgcggacgcgagggggcactgtgagtccgctttggcgagggagaggcggcggcccgcgcggggcggggagggctgcgcccttccagcatcccagcgcccaggagcttcgccacctaccagggtccgagaccttaactcggttccggaaagggcgtcccgggtgacccaagtttggggccacaagcagctccaccggctctccgcgttggtctctcccctccccctaagcagacagtcctttctgccagctgtccttaatttgagattcgtgagtcccggggtttgggaaaccagaacccccctgcgactgtagggaacgttttgggtgcgcctatgtcgggtattttcctgggcaaaaggacagaagctgtcatctgattctttaaggggttcgtgtcccaagagggggttaagctctcttggtttaggataagagggcccacctaaccacccacccaaatgccaaacacacagcaggtcgagaaacgactctgaaatcactccttgtccacttcccaaggtcgggcgagagactggcacgccccacgggcaatcttcagaaaaaaaggtcagatctggtccttaaacagctcaggtgcgaagctgaatcgcccttctgcggaaagagaggagacagtacctgcccccgccgtccctcacttcccttagtcccaagaagaggtcagacaccgggaaatggggcccaggcgcttggtctgttccacctgccactcgagtccccagtcccaagaggctgctcagacattggcatgatggggaaactcgattgattttgttacctcctagagggaaaatgccgtgggcggagatgtctgagcgtcccttccaacacgagctgggtggtgctctattgattttcacgcgatccccgggcgggagcgagaggataggctcggattcccgggctccaggaccgaacgcctggcagtgtccccgggggcaaagccaccccgggagcccgtgcagtatactaggtggggggcccggagagaaagcatagcgccgacgagggggaggggccgggcagaaaggagggtggggtaccgggtgggacacactgacctaggagaaagtacaacccaccccaaactttcgcagacccgggagcttaggaagggagagccaggaagacagcagcctctcctgccgcccaacgtgcccagctgcagcgaggaggggcggcgcgcaagccggctggacccgggcggtccccacgttgcgcccaccctccgggccaaaacgccgccgctcgggtcactgagtggccgcccacggaagaagtcagatcgccgggctctgggctgcgtacgggatccgaggaagggggattcaaacgcggatccggaaggaagggacactgaaccccgcagcgtccccagcgccgtggggcggcgggacgtgtccttgggctgccagcgggcgcggaagctggagtccggcagggtcgggaagaagtgagcacagacttccacgggtagaagagtcagattaaacagaaatgtgaaaagcaacccagggcagccaacggagcccagcagcgtagaagccaccggcttcccgccgggaggactacagtgactgacactcgcgaagactaggcgctcccagcggccgcgggtctgcgtggagaagtcgcctcgcggcgcggagcgcgccagcggcggcggcggctgccagagcgcgagatgcggcgcgcagccgccggaccgtcccggctgggaaaactcgcgggcggcactgcgcagcgctgacccggcgcaggtccgaggggtgtgccccggcccctcccgtctccgccccctcccgcgccagtcgcgcgcccctccccgcggcggcagcgtcggcggcgcatccaggggcggcgcggagccttgctcagcccagcagccagtgcctgcgagctccgctgctgcttggggaattcactttgctgcttgttcgcttctcccttcctcaggcttcttctgatggttttccgtctcctgcccgagcctttcctttaaaaggaaaactttactgcgatacccttttccccttggaggagaggattaaaagttccaagaactggtgccgcccgtgccatttgggcgctgggaaggtgctcggcggcggggttcccggtcccaccatgtgcaccaacatagtttacgagtggctcaaagcgctgcagcttccgcagtacgcggagtccttcgtggataacggctacgatgacctggaggtgtgcaagcagatcggggacccggacctggatgccatcggggtgctggcgcccgcgcaccgccgccgtatcctggaggccgtgcgccggctgcgggagcaggacgccaacgccgccggcctctacttcacgcttgagccgcagccggcgccccccgggccgcccgccgacgccgtccccaccggccgccggggggagccgtgcggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtaaggaggtgccgtccgggcggcccggggcgcgcggcgggaggggacacagcccagctgcctgtgccaaggctttgcaacccattccaggtgacgacggagaggccaggaggctttgggtatctgggacccttttctatgttctttctgtattagcccattatttcgtccttcctggtgtctccagtggttggtaagacaagcccccgcatccagatgttatctctaaactaacgaccaaaactccgcatcctctctggtgctcgcctgtcaggaatcggactcgcgctgcttcacctggtagccagggggaattcctaacgccctctatagtagttttgggtttgaagagtaccagaaaaaatggttaatacctacattgctttctaccttcctttttctctttcttttccttttttgagtcttgagaaactcctaagggaaatcggtgaactctttaaagagtggaaagtcaggccctgcctttctcaattccataaaaaatcccagcgctgctgcaaatttgagaagcttaccattcacatgagcattttaagaggaaaagtgaaggaagcacgtgtcagtccacttgagatgatttcctaaacttgtgtatactggaggcaataaggtgctaaggacatcagagataatcgggccacaggatgtgcttcagaggtctgggctgtcacgagtttggtttattattaagccagataagatgaagtaggtacaactgtgacttccaggaagtgtgagtggacctgcatttgggagaggaggaccgagcacaagtgaactaaaggggaatcctctgcaccgggggcctcagggaaggaacctggaagttccgaaatgtggagtgggagctgggtaattaacagaaaatggtacttcacaccagagctctgcttctagctgcgagtctgttccgtttaggtttctagttcaggcggctgtcggagtagagggtcctgacttgatagagaagtagacagcacaggtaacgctcaggattgcagaaggtgcacaggaatatgagcacctcagcttaaaaatcaagacttagaagagcccagggagaaaatgatggcaaacatactcagctggtgggccacagaaacccaactccctaataggaaatgtggataatctcagtgttgtgtgggtatcttgggccctggtagtattgctgtagaatcttaagtaaaggctgtaatgcctggagttaaggaagttaaagggaaagctttgttaagagtagataacaatacctaaggtagatgggaataaggggtttaatattatctactaccttgcacgtaccataggcaattcagatcacctgcttgaccatgttaattggttttttaaggaggatacaaagaaggcaggttgggaggacagagtgcttcaaattaaacacgtgttccagttacccactctgtgccactgatgtgtgctcaaagcaggaaaggagagaacacttttcccaggcagttgcctgtatgtaggagttccatgtatgtctggtgtggatagagagatctggtcatcagtataaaggcttggtcctggacacagcaggtcaaaggagatcaaagccagttagatgtttgttattagcatcccgggaagtaaggtgggcttagtctgagagaatgtgagtacctgggcacttgataagggcacagttcaagtcctggcaagaaaggaatgcagagagcaaagtgtgtcactagagcttacttattcttcaggaaaagtgctgtgtaatggggcggggagagcagggacaccgtgggctggaggtgagaagcgtaagcttgaagtgacacattttagttctgattcttaaaaagcaaaaggcagacctacatatcaaacatagaggctggaaaggatgttaaggggatgaaacgtcatcagaaatgtcagcacataggctttgaactctggtctcctgcctagatcagtgggtgctatggtagtgcatttgcataagtgcagtttacataagaaaatgccaagttgcactgcaatactatttactttccatgtaaataattacttcagtcaactttgctttaaaataaatcccatagcaataatgcttgataacaaagatatgctcctattcactttctatacatatttaattctcctcaaactgatggaagaataaaatagaaacagaagtgttttcattatctccctcattgatccttgagttggggaccaaaaaaaaaaaaaactggcactgacaaactttattgtaacacacactgaaataggaattaaaatataattaatgtacacatataattaatatacatatatagcaaactgagcatacaaatgtttagtaccagatcacgttgatcattctggatttgttgcttatatgtgcattgcctcttaagttttggattttaaattattgaagaatttgttttctgatgtagctagtttcttcatgagcagtgctagaactttttcttttcttgtgtgatccacattctaatttctccactttccttggctttgtcatgatcagaatatatagtattttttgtttgtttgtttgagatggagtctcattctgttgcccaggctggagtgcagtgccagatctcggctcactgcaacttctgcctcctgggttcaagcaattctcctgcctcagcctcccaagtagtacctgggattacaggcacctgccaccacgcccggctaagttttgtagttttagtagagacggggtttcaccatgttggccaggctcatctcgaactcctggcctcaggtgatccagccaccttggcctcccagagtgctgggattacaagtgagccaccgcaccccgccagaatgtgtagtatttttgatgtgcatttggaattctgcttggtggagtgggcttttcagtctcctttgcagtcatttgcatcaatgatgcctgtgattttgttttgctgagaattttagatggcttgaaggtgaattatgccaaagattatcaagatagggagagtgagtctcttacagaggaaagtaagttgaggggtcttcccaagaatcacctgaaaggattgtaggatttgatccagtaatggtcaaagttatgcggtttagggatcagtgagttaaaacgtaaataaaaagtaaattttcttttgttttccaaagggaactctatagctttgaaaaaacaggagcttagagagagcaccaggctttaaatcaaacatcattggaagagttcctcttctgccctgtatgtagcttctctgactgctgtgatttctacctttgtgaaatggggataaaataattttttaccaagcttctctatgccaggccttctgttggactctgggttactgtggttggcaggatgtgaaagctctgccctctgggaacttagcatctagtagggaagacttaaaatggaatgaacaataatgataatgtgtgacgattgatttgatgagaagtacatgataccatgaacaggtgcatccaacccagtttgcagggattgggcaccatctcagtttttccagaactggcctatgacctgagtactgacggttgagcatatttagcctgaagaggagcagggtcttaagggaaagagtgttctcagcagagaacagtgtgtgcaaaggccaggaaggggaggaagtttggcatcaacaggaatggcaaggaattctgtctggttaaagcactgagtgcctggagaaagtggcaggagatggagaggcaggtggcagctggtcttgggtggcctagaagtcatgttaaagaatttggagtatatcttgtgagcagaagagagctattgacacatcctgaccagaggcaagccaaacacttaggagactgttgcagtgtcaggagagagacactagtggcatgggccacttatgacagtaggacagcagcaatggaagtagacttgacagaacttaaatgattgtttggatgacagggtgggaggggagagaggttggaatgacatgcagattcctggtttaagattgtgatgtgatgtaggagacccaggagaacagcgagtttgggcgagaaagatattgccttcaggttgaaacatacggagtgtgagatgcctgtggaatgtccctacatcacacacagcacactgcagctgtgactacagatgagcagtagagggaggagccctggggaacagcaggatttcagaggcggccagaggaagaggaagctctaagggaggctgtaagtatgttttattttctagcagacttgtcaaagcaaaaggtaagctctagggtcaatagtgtggagagattgacaagggtaagcagagggtaggtggtaagcaaaaggaaggggtgttctggaagccactggaagcagtgatgtttcaaggaggagggacaggtcaggaagtcagataatggccaggtaggacaagaacagaatcacttcatgggaagtggtaaccatgccgtcgaggacctttgccacagcagatttggatgatgggaccagtgagagtgcagacagggatcacccacaactttgaaaccaagtttgatgagatgacagaactaaggttacagccggaggaggaagggagactttgttgtcaagggaagggttttgtggatttgtttgtgtttaggatgagagaatctggagtatatctgagtgtgaatggtaagtagccagagaaaaggagatgttgggggacaacccaggagaccagggtcctggaggaggtgcgagggaattgtgcccagagcgcataagtgaagggagcattcgcttctgcttctggcgggtgggtagcttctcctccaggtcaaggggagggaagaagaaggggtccggagactgggacctttagaggtgttacaccaaagagctctcatttctctttctgactgagtggaaccagtgagggaggagatggaaggattagaggtttaaggagaacattgtattaatatagaaatgttagatgttgtgatctagtgggatcctatacattccatcatgtaatgtttagacatggtcataaacattacatgatggaatgtataggattctaagtatgcacattaagaaggtacgctcaccattcacatattcgtgctgtaggttacaggttgtgctgacgttttgttgaatctcatcatgtctagcagtgcttatagggttgtggcagatgtgaagggtatggggctgtaaatatattttattttctaacagacttgtcaaagcaaaaggcaggctctagggtaaatagtgtgggggaggcatctagattttttcactgaaaagttgctccttgccacatgtaccaattaaaattgtttgagttagtataacattatttaatactttcgtaggagtgttcatcttcattcatacccttcgtgtgacttttatgaggtaacaagaatctcatgctaataaggctatttatggatattctggagagatggcctataatgaaggaatttgaagagacagaggtagtaggaaggtttctgtcactggggccagggtgaaatatttagaaaggaaagagagagattggcaaagatgtgcttgtgtcctttggagttttgccttgtgtgttggcagaagctgaaatggcaataaatattcctcctcccaagaattccttctgcgttcgtgacattactagggacagattggaagctggaaaacttcagctttctccaactcaatcagtgtcctcaaataccctcaacctatatccttccaggtttttttttttttttttttttttttttttttgctttcagtgcctgattggaacactgtggaaaaaagtgggggcaggaaggagacaagagctttgatggtgtggggacttctgcctttgtgtactcctcacagtttactgcctgtggagtttccacataagtggaccatcagccaactgcctgtccacccatccatccatcgatttattaatctgtccatccattcttccatttatccatccgtcttccatccaaccatccatccatccatccatccatccatccatccatccatccattcatttattcattcatccattcatccttccatttaaccatccatctacccattcatccatccatccttccctttacccatccatctctccattcatctatccttccatttatccatccatccattcatccatttatccatctatccatccatccttccacttaacaaatactaagcacatgcccatgtgctaggctttaagatcacaattgcaaggaactagacagacatggtctctgcttgtatgtggaggcctaacctaatgcctgatgtataatagttgcactatatcaaagttgaatgttatttctgcaaacatgaaggattggaggatgttgcacttgagtttatttcaaatgtttaaaaaaatcaactctgattaaaacccaagtaaagataatgaatgatgaaattttgaatcaaaatatttattcctcaagggttaatgaagaagaactgggaatgaaaatgctactcctgtaggacattttaaaagaagacctctctctgcagcatggccaggactagggtaaagcaagtgagatgacaccaaggacacaaaattgaaggaggtgctgattctcaggctcatgcaagtccaggctgggctagatggctgaccaccattaacaaaataaattagttactgtgaaatattaggtattaagaggtattgtaggcattcctcaaatcatacaccaagtcacctactcttctatgcttaatacctgtcctcaagagcaatgtgctgagaaccatatcagtgcacatctatcagtgcccatctccccgactaagaaaatatggcttctgggagctatggcagcccatggaattcatttaagtaagaatggtactgctttctgctgatactgtagtgtagtggttcagcgcaacaggctcagaaccagacatcagagttcgagtcccagctctgctccatactaggtcactgttggctcttctgtgaaatatgggcaaaactagtgattaccacatagggttgttatggagatgagatgagctaacactcatgaacttattagatcgacgtctctatgtatcctagaactgccataaaaagtgccacaaactaggtgtctaaaacaatagaaatttattctttacagttctggaggctataagtccaagattaaggtgctgtcagggtctttcacaaaaaccctagaggcctgcactgtgagtcagctctaaggcccagcaaaggctttaaacagcatccatgtctgccactgttacttcaagtaccattggatctgccggatcatatggcccaagtcgcagagcagcttgcacggcagcctggacctgctgcagaaccttctttttttctggctccagtcaaaattagcagctttggggtcactcagtaaataggtttttgtagcatacccaaatgaagaatatgttgctttcaaaattcaaagaggctcaccggatattatgtgtccttcttggttgtaggaaaagccatatgcaacaacttattcttcatcttagaagggatatcttgatttgccccatgtcactggacccctgcagttttcactgaggtagaaagtccctgattttttgtcaggtttattttccaccttctgacatgcaaagtaagtctaaagtaattacttcatttcaatcactagatccaaacagcataatgtcatcaatgtaatggacaacaatgatgtcttgtggaagagaagggcaatcaaggcccctgctggctaaatcatgacatagtgctggagaggtaggacagtgaagctgtattgctggccttccagttgaaagtaacctgcttctggtgttctttactaacaggtgttgagggaaaaagaaacatttgccagatgaacagcctggcttatgtaagcgctcacctgtggtagctcttctgtacctgggtttgcttggacatctcagcttccatcgtagtggccatgtgtcagctgtgtacagaagggtctgctgacccagatcttattcctaatgataggggtgtttgatgatttttagtggaaatgatacccagtcatttctgtgtaccggaggatgcaataacaaaactgatttttttaaaaataacatttcaaaatttagatattcaaaattaggtagtaatcttgaaaatagtcacttggaagatcacagtgttgctgtttctgtgttgctgtttcttagaacatttctagaactctgatgtcacaaaacattctttggagtatcttcagtggtggcaagccttcattcttatcagatagatctggtttggggtaaacacctaaagtaatctggagtcaaatcaggcagttaagagtaatgacattcagtaaagtgtgaaatggaaaatgtaatcttggcaacaaaataatgaggtgttttttttttttggtatgacttatggaatggttttcagattttatgatacttatactcattttccctagttttaaacactttaaaaatgctcttagtgggtatccatgtttataaatatgcaaattcctccaaaatgcttttcaaaacacgaaagtcaattccccatgtatttgcaaagagcaaggcacctgtcatggtctctccagatagaattttagtgtaaaggtgtctgtggcccaaaaggagaggaattaggtaaatcgtgcccggatatcagtaaactgtgcagcactcgatggattaatcaggatttggatagtgtaacggtgtttttagggctcttcatttgctggtccttctgttcttagaaagccctctacgaaactaccaccttatcaagtcttaacgtgatcatagctgtactcattctttcctccccactcttgagtgaataaaaaggtgctaaaggcaggggtagcaatattaaagctgccctcatgaactttgtctgttcttcagtagttatcttaggcatacccatgaaaaataaggtagaaataagaactatatatatggataaacatgcaattcttttcagattctgttcaagtgctcagattctagttcaccagaaatatgttctgaaaccaattttcctgaagtaaggcgagtcagatgacgtggacttgatgagggctggtcccagaaataaagaagggccatcctgaggtgaagacaccctgaagatgaaagaacactgtccggggtggaataaagtacactgggaaccataattgatgacacacagcttctcaagtttatagcgtgtgcagagctagaaacaacattgcatttctggctatgggaaaggcttgttattactattaatactactagtattgagttgaaaggtttttatcagtgattttctaagttttatgaaaaaatgctgtttcagatcagccactgatttggacttggggaggcctgagagtagtgagggagtccccattttcagtcaatataaaaactactaagggccaatgactgtggatcatgccaaaaggcattaaacatacaatctgtcttacataaagactaagtgacatctaatagtttaaagatatctcattactgcttctaattgaaataaatggtctgatgctctctaaaatcttactgttacatttccataaagttaaaaatgcaaacaaagtaagacctccttgatttggaacatgtcagaaagataaggaaaacagttggtatgtattctttatttagcaaagttgtaatgcacagatttgacaaatttaaagattttttcccctagaatataatgtaactttataataagactagagatgtacctactgcatttgatacccaaaatgtatcattttttaataccttcacttttatatgaaaatttactttaagtaatagtcatgtaataatacacagtaattattattgtcctcattccttctttagttttaaagcatttaataattaaacacaggaataccttttaaagtattaaaatttagtaaaaatatttcatctgcaaaacagaatttgcatttaccaaactcaagcattataccttgcagtttgtattgtttcactgttttaatttttcaacacaaataaaaacttcaagtggtcacataagaataaaagaactaaagtatctcaaattttgtttgctcatttttatatatcatggtgttattgtttatttcaaattgactgtttaactcaagaatatgtagtctcatggggaagatggggcagctttacaaacttactcttgaaaaggactctttagtcaagtatgtgggttgggggcctctgaattaacttccatgtagaatacaatgcttattaaaggacacgtaagatgctaatttgaagcttatacaaaccatgaaaacttaacatgcagcaattagcatcgaggccaacaaaagactttttcaaggtgaagtgtttaacactgacattgtttaaaattgtcagcaggacattttcataataaaaagttttgtttttaaggactcccttattcttacaactgaagtgacccttccctctgcctggtccttgaaacgtgatcactttaagagaagtttatttcttctgtacagtggtgccaatgactgtctcacagagctgtagtatcaattaaatgagataatacttatgaagttgctttgtaaaattctaagagaactttatagtttttttttttttttttggagatagagtctcgctctgttgcccaggctggagtgcagaggcaccatcttggctcactgcaaccttcacctccaaggttcaagcgattctcctgccttagcctcccaagtagctgggactacaggcactgccaccattgcctggctaatttttgtatttttagtagagattactaaatttcaccatgttggccaggctggtctcaaactcctgacctcaggtgatccacctgcctggcctcccaaagtgctgggattacagccgccatgcccggttgagaactttatagattttaagtgcccttactgacagtgagtaaaccattatgtttataacaaaatttgaaaactatttctgttaaaaagcaaacacattgtattgagaaaatttggagaacagtgaaacagattgataatttaaaatcgtctatattacaatttatgacattatactgtatttctttaaaaatcatttatgtgtcagaatatatgttttatactgatacacaaaactagtatcacagtctaaatggataagagtcaggctatttttttgtcagtagctgtcatttgaaaaatgattttctcctagctttattaagatataattgacaaataaaaagtgtatatatttttggtgtgcagtgtgatgttttgatatatgtatacattgtgaaatgattaaatcaagctagcttatccattacctcacatacttacgttttaatgatgagaacatttgagatataatctcttggcaattttcaagtatacaacacgttattattaactgtagttcccatgctgtataatagatcccagaacttgttcatcctgtctaattgaaattttataccctttacccaacattttcccattctccttccctcctgaaaaatgattttaatcctaatacatattcaatctcaagtcaataccataattaatttaaacatatccttattggcatgaaatcttacccatgttactactaattattatttttttattatttgaaaatgtcacgtttgagaagtggtatttcatcattctttgaattacatttcttagattaccagttcatatagttttatatttgtggctttttatgtataattatgtattgcctgttcatggtacttgcttcttttttctactggtcttagaccacttcttgttgctttggaagagcttttatgcattaaagaaaacaattgttatttcatgtagattgcacatatttttcccaaacataagaatgtaacttaccacataattttatgagttttttagatgtccagaagtgtaaaattcttatattttctgccttttcagtaattttttagctatttctttcaaattggagaaatagagagggtgcagtctcaaacaaaattgtcaattctttctttactgtttacttgaataagttatttagtctttgtaaacctgaattgcctcatctataaaatggatgtaatattacttattaaggctattgtgaggaatcaatgaagcagtatgtaaagggcctcatataatgcctgccacacagtaatcacacagaacatctgactaatatttataatgttatacataatgttatgattgtgaagtggttctcaatgtgaagaccttatcttaaattattagttcatttccttgccattctgtggagagtgggtgttcttgtcataattttaaaaccttctttaaataacaagaacgacaactttttttactgtcacaaccattaaaaaataatttgctcaatttgtcatttgccttttagttttctttgtttaattagagaaagcaaaccttcttttgtgattgcttttatctttccaaatctttttcttgtccaaaatccattaattttcacccatatctcccattaatgtttttgtttcatttttacatgtaactgtctaatctgtctaagtttattttagtatgtgatataaggtaaagctctattgttataaaattacacacacatgataatcttatctcctactttacaggaattacagctcttatttctttcttctagtgttattgcattggctagaatttatatagccatgttaaataataatgacaactaggtattcttataattttcccaatttaaatggaaatactgaaagtattttgctattatcctgctgctggctgtcagtttaacgtagttttcatgactatattaaggaaaagcattaaggaaaacatccttcttttcctaattttgtaggagtttttattgggattgaatatttaatcctatgaaacatcttttaggcaacttaaaaataatcgagagctttttaaactgggcccaatattgtgatgtattaatattacattaacagatttcctagtcttaaactatttttacgtaactgagaagaagtaaaaaaatgaaactatagcttttaaagaaagcagagtgtgagatgaggaattcataataatcttactccaagaccattatacattcttttacactatatatcttttctttcatgaaaaatgtttgacatttaccttcagttgtgtaatcacttcaatggttgttgtcatgataccactacagttgatttcctgccagtaactttttggaagtttcggtctctgtctagacaggtacatgaggcagcaatagaagtggggcatggggaccagcacccctgttgctcaaaaggcagcagccacatagttgtgggtaaaggtttccttttctggcttttgcagacattctgtttttgaactggggacagagactgtgagggggcaaggagttaatttgaatctctactgattttactgtttttcacagtaaagaggggctttttttctcagtatagttgaggaaattcctcccaggttctggaattctattcttcttcatcctccactcttctactcacctccccctcaatcccctatagtcggctcccttcctgctcctaccccaccccagacctttcagtgaaatatacacttaggagctgcttgccagatgccatgtcaaattgaaaacccttataaaataaattgaaatggcattcattctaatttgaatcatgggctttgcatagaaacaacaactcaatgtgtaacaaaggtaaaattgaaaattctacaagaaatattactataacaaatccttgatttacatttaaacatttattgaaacatcaaataggtggattttttaaaaaggtcattgaagcaaggattaagaacagggtacaggaatagtattttctggagaaaatacctcaattgagtgctaaactcagctgagtttgcagaaatgaatgcacccaacactttccaaggtaaccatcaatcatgcaataaagatatagccactttaaacaacaatgtatcaatacagaatggaacactgctatattaagatgcactcctctgggaagttcttgattgacaaaaatagtactgtgttaagtagcagcagtattttcatggccagaaagtaataaaactaaagatgagctttatgaagagaaaagattttacatgaaaatccatggagcaattcttaggacttgcttccttcaggatcaggttaaggggcaaaacgtgaaatgtgaaagtggaaactgataatttgctaatctgttaattacctgcacagctggtcctgtagtcactgtcatttataggcatctgaagaaaggatgggatagttgctgcccgggatcacacaaactcagtgtatctctggcttccttaggcttgtacagtaggaaaacaaaatcaggatattcatattgaacccattatagattagagttgagccaggggtatgcaaggaatttactctttgagacctacttcattacagagagttggtagagagtcagagttaggttggtgacattaacttttcagttttattgcagtgtcattttaagtcagggattttactgccactttttggcatagcagtttgggctagtgtatttctctctctcttaatgtgatccttcatgttgatatacctaccttgaaaatggtggtgaattgactcttccgctcttcttctgatcacttctccaaacactgtggcatgacccactttatgtgttctctgtggcatgacccacttgacctgctctccgacagcaagtgtgatattcttgatcatccccaacatagctggttttggatgagcatgataaattatagtaacagtggtttggggggaaaggggaagagtaatgggtttttttgtttttgtttttgtttttgttgttttttttttttgaaagcaggcaaattgtaaaagcaagagcgcctataatagtgaaccgaagctttattctgaaaaccttttcatcgtgctttgatttcattgattgtaataatttgacttcttcttcattcagctatatgttaattagtcacagttatgtctgccattccttttcacatctggagcggacttctctgcttgcttgaaccacctacctccttctccctgtggagtttagaaaagtaaaatattgttttccattcgcacctagattcgctttttaaaataagactcacacaagttgggagaagcttcatgctgttggtggtctcgtcagatatattaataacataaggaaaaagccttgaaatatgtcaaatcacaaaaacagtagtgagtttatatttattatcatttgtgaagaatgctttaccacattatttccttcaatcctcacagcaaacccttaaggtagagactgtttttcccattcctgttttatacacagggaaaatgaggcttaaagagcttaagtaacttacacaaagtcacataattagaaaatttcatttgaaagccacatgtactgacctcagagcccgtgggtctcatcactgtgcaatttctccaagaaacattgctttataagatttggcaactgtctgtttctctgttggtgaaaaatagatatggtatagggagtgggtatgtcttagagatttttatttaaaaaaaaagaggaagacttagccgcctgtgccctcaagaacttattgtggcaataactgctcaatcagtagggtttacattgactgtggtaagtaggaggagtagctgtggggacctgtctatgtggttcatggaatgggcatctagtatggcagggaggaagattttcatggaggtggtgatggtatggctgacccctgaagacgtgtgttggaggcaagtgtgtcatcaatttggccagcctggagtgggaatacattttgaaaagtccatagaacactaatacatggagaaataagaatagattggaatctgtggaaatggtgtttaatctttcagtaaactctattaattgatatccgaagtgttagtagctagaggttacaagggtaatgactgtaacttttcccgcttgtgacttggcattgttgttactggcaatggaaaggccgaatttaaatcacagtcatcggccttctaaagtgagtggttcagaatttaatcaaggtgtgagctatgggggttggttactatgtgagcgaaatcaacacctatgtcacaaagtctgatgaagagagaagcctttgccagtcagcattagggaggcactggttactgccaatgtccctgaatgttcttgaccagttctgcttctttagcaggatcagtctgttgatgtgttcacgtacaagaagaaaagcacaaccaagaaagccagcatgcctcctggaaagctagatggtttcatggtggtgacatcaatctccaaactaatcttcaatttcaacaagcagcaggtataggcccagcctgttggccattatctttggatataccacagagaccacacctggctgccttttgacacttcatcagtgtcacctacaaccacactcttcaaatagcctgctagaaatgaattcctagggcagagctaggacatgatgaactgggcttgttgcaattcaactaaaaagcatggatatgtgcagagggaatgggagcagtgttttgcagggaaaccactttaaaactggagttttataggcttaggttttgtgagtttcatatttgtgtttaattgtgcattttagcctattacgtgattattaattaatattattacttacattcagcaaatattaattgagcaccaagaatgtgcaaagcactgttggggtgatgcggggaattcaaaggtgacaatactatgaatgtgccctaatggaaattacagtctggagaaagataaacacacacacatccacagatccatccattcatagatatatatgtaagtaaacataacatttcagcatcatatgaatgccaaaatgaaatacaaacctgtgggagcaccaaggagagaactattcattttgactgaggtattggagtatctttcagccgtaactgaatgtgaaggataggtaggattttactaggcagagccacagtgtggactgtatactggaagctaagggaactggactgtgaactccacagggatactgtccatttataagctttttgtatattcagcagcttgctataaatatttattgaatgaatgcatgcatgaaacagcattagcaaaatctcagagtgacaaaagtgcgaggtttggattggtgagtggtccactttgggcggcaatgggatgggagaaatgaagcataaggttgggctgagctgttgaggaacttccctgtggtactaatgagtttagaattcattccagaaactgggacctgtcagatatatttgacctggagaattacctaaccctgtttatttaatgaagctccttcacatttttaacatttttggatttctttcccattctctcttcaggagttcctaatctctttatccatagtcaccccttttactgtatcccaccttatcctccagctttgaagctttggattgaaaagctttgctacattgcttcagtgataatcagttcattttcctcttttcattgatcaaaggcacataactcagtgtactagtccattctcacattgttataaagaaataccagagactgggtaatttataaagaaaataggtttaacaggctcttggttctacaggctgtacaggaagcatggcaacgtctgcttccagggaggcctcagagagcttttactcttggtggaaggcaaagtggtgatccagcactgaatatggccagagcaggaggaacagagagcaagggcggaggtgccacacacttttaaacaaccagatgttttgagaactcactatacatttccaagggggcatggagccaaaccattcatgagaagtccactgccgtattcagtcacctcccaccaggccccacctccagcactggggattacaattcaacatgagatttgggtgggtacgcatatccaaaccatatcatttggcccctgacccctccccaaatctcatgtccttctcacatttcaaaatacaatcatgtcttcccaacagttccccaaagtcttaactcattccagcattaactgaaaggtccaaagtctcatctcagacaaggctagtccctttcacctgtgagcctgtaaaatcaaaaactagttagttacttccaagaactaatttataaagaaaataggtgtttttaataaagaaaggttttttttataaagaggtaatttataaagaaaagaggtttaattggctcacagttctgcaggctatgcaagaagcatagcaccatctgcttctagagaggcctgagggagattttactcatggtggaaggcaaagcaggagcaggcatcttacatggcaggaacaggagcaagagagcgcgtacggggaggtgccatacacttttaaacaaccagatcttgtgagaactcactcactgtacaaggggggatgctgctacaccattcatgatgactccaaccccatgacccaatcatctcccaccgggctccacctccaacactggggattacaatttgacatgagattcactggggacacagatccaaaccgtatcactcaggaaccggataaaccagcaagggttaagcatggatttaactcctgactgtattagtttgctatgcctgccctaataaaataccacagactgagtggcttcaacaacagaattttattttctcacagttctgaaggcttgaagtccaagatcaagttgtggacttctgaggccacgtgccccagcttgcaaatggccaccttcttactgtgtcctcacgtggtcacccctctgtctgtatcttgcctgtgtcctaatctcctcttcttataaggacaccagtcatattgtattgggacccatcctgtgaccttattttactgtaatcacctctttaaaggccctgtctccaaatacagtcacattctgagggtcaggacttcaacatattaactttagggggatgcagttcaccccataagactgacctgaggagttaatccaggctgtaccacctgacttagaaagttatgttgtcagtggttaagttaatcccagtcacatgtggtaggaattggagcttgaatctaacagctgatgaaactaggtggttgcctagtgaaagtggtctcctctaaatagttcagtttctaccacatgcaggagcagtcactattgcaataactttaagtaggcttggaaaagatgaacataaatccactgcacatttgcatggcatttattagagaataaccccctaaacaagggccaaacagtaccattgatgaaataaatctcagactcccaattcacatggtcctgactccatcacttttgacctgtgtgacctcagccagattgcttcagctttccctgccactgtttccttatagataaatctaacataacagtgtttcctcctgcctagaactattctgaggattaagtcagaaaatgtatgtagagcacttagcttagtggttggtacatagcaagcacttagtaaactattatgtattcagtgttagcttttattaaagatgaaaatggcagatctattcacaggcatgttagcaataaaactactagggaaatattagtatttgcatttatatttatgtaaatcaaataagttttcataggttggcaatcatgtttttaaaatattataaatattgttcttctaaccttatcaattaagacatagattttattcttatctataccccaatattattcaagaataactttaattggtcttaatccaagagttcgatgaataccaatttaaatgtaatttaggtgtatttatcttctagaattgaacattctcttccgctaatagtataaactttaattgtcttataatgtatacacgcagatgaactattcctttgtgttgctaagatatatagtatgattggacactgttattgtttcattacagacaacctcataggaagccttccagaaggtttgcataaaggaatatagcacacatagaaaatgctgaataaactcatcagtaatgatttccttgggtcatttttactttctgcctacttcatctccacctctaagtaaagcatttcattttattaatgtttttcataccacttattttgctagtattatactcattttagaacatttttaaatatccaataaaaatgaattgggcacttacaaatattttgtactataagactgtttttgaatattgtcattaaaacagttatttcaggatttcccagtttatacaatgcatatggcaactgagatacttatgatctgtattatgtgtttataagaataaagttagtaaaaaagatttattctagaaatcagttgagaagacatttaaaaatgtcatgtgcagttgggattcttcagcaccttttcttatggtgtttctttttttattttcttaaagtatgtttttaccatatatggggacgattttttccccctggtatttaggctttgcgtaaactccaaacagaactatcaaacaaacatattagaggtttcgctgcagaaaggacaatatttattttttgtgtttgagatttctgtgcagtaataattaaccttagattttgaactatcattggaggtgttgtggacaggaaacacattgatactggaggagaaattatttttggcaatacggtaacttaccaccttgtgcacacaagcactgcccatgtgcagggacgttttacttgtcaagatttacctcggaagagcatggtgtgtgcgcagcacaaaggcggcaggtgcggatggcttttttctcagtgatagggcatgtcaattctcatttcctatatgctgaggagcacaaagggaagcagccggcattgccctctggggccaaccagctccttccttcccctcgcatcttggagatatgccatcctgcccaagtacctgcctcctgagccacaactggcttgtggttttgctttttgtctttgtggtccttgttgaggtttgtgcacttaataagcagaaccaccagtgagaggcaaaccttgcagacaggggaattcctgcaaaagctaagaatcaccgactgaaaagaagagagcaaaggtgcaaatggcttggggtggagttgaggaattgcgggaccaggccgtggttcccaaacacagagagaaaaagcacattcagggttctgagccccaggcattttgcgtaatcagccttctttgctgtttctactgtttgatgtcttaatctgttattctgggacctataaaattgtggaacacaaatccaagttaatccaagttaacctctgaacttgacctactttcatttagaattagccttatttaaagttgtaaactacaatcatgactgaagcacactaaatagtgttctgtttataaaacataaacctttttctctttactgtaaatcctttctggctgaagaggtctatataagaaaaccaggatatatttttcagttatcccaggacatttaaacttttgaggatttaaaaatgatagtcttaaaagttttttttttttttttgtcaattttagagatgatagaggttctttaggttctaaaaaattacttgattaattttggttctgatgttttagaaaaatattttaatcctgtttatgtgaataaagtccagtccacatgtgaaattacactgaagccataataatcagttatgattatgtaaattgtagaactgattttggctaagcatttcaaaatcctgcccaaaattgcagtatttaattgtaatcttagattattaccaggataatggctgttttaaatcttcttatttccatataatgtgaaggcaggcccatgccttactcatctcatctgccccaggcccggcataatgcctggtacctggcgggcacccagtgagtgttgctctgaatggaatgctcactgggacacattcctccattttcattttgcccatcagtgcaaacaaacctatcaaccaacattcatgtcagaacttattactcattattgcaactgtaggatggcttcccatataagagcttggccaaaatcaacaaaaaacattctgtgaggatcaattggatatatgaagttgataatgagggatattatagagtttatttattttgtaaattgtgtgctacatagccttatattttcggtctagaaaaaattaattttatttaaagatgagtaataaaacgacccataatagaaatttgtacgagattatatcatcaaacagttttaaaaaggaggaaataggagaattatactcaatataataatttctcttggagaagataaacatactgaaaaattttgtagaaattcattggagtaatcatttctatagaataggatcacaaaagagatagtaaaactaactataacgtagacattaccagaaaacaaatgtttgtctcttttttcattgctctattactatcccctagaacagtgactggcacatagagtttcatatatatatttaaaataattaatttttatttcagttttggaggtactagtgttttttggttacatagataaattcttaagtggtgatttctgagattttggtgcacctgtcacctgagcagtgcacactgtacccattaggtagtcttttatccctcactcactccctcccaccttcccccacctccctgagtccccaaagtccattatatcattcttatgcctttgcatcctcatagcttagcccccacttataagtgagaacatatgatatttgggtttccattcctgagttacttcacttggaataatgacctccagctccatccaagttgctgcaaaaaacattatttcattcatctttatggctgagtagtattccacatcccacattatctttattcactcattggttatgagcacttaggttggttccatatctttgcaattgcaaattgtgctgctataaacaagtttgtgcatgtgtctttttcatataaagacttcttttcctttgggtagatactcagcagtgagattactggatcaaatggtagttctacttttagttctttaaggaatctccatgctgtttttcatagttgttgtactagtttacattcccacccacagtatcaaagtgttcccttttcaccacatccacaccaacatctacatagcctttctatcagtacggtttataacatagttataatgaggttatgaatgggtccacgtgcatacatttttcctcccggagagccagttgttaaacatttagccctgcactaccgagagggcatttttattatggttacttctagttcagattttggctagtaaatgttaaccaaagttcttttgaactgagattcaggggagtggtggtgttttacctcctgtgttgtcctccctgtacagcagaatgaaagcagtgcagccatggtcaggccttgggttgggaagggggctggcggtgccagcagaggccagcacacccagagcccagacccaacataggggcccagaccaatccaccaagccccggggcaggtccagggcttgcagggcatgatgtttatgaaatgtaaaggtcttctttaaagcaaaagaatgcaaaattaggtaaagggcctgaggcctcaacttcatggtagacctactgatcaagcagagagagcatttaagaaaccaaggccgggcgcagtggctcctgcctgtaatttcagctactccggaggctgaggcaggagaatggcttgaacccgggaggtggaggttgctgtaagccgagatcgcgccattgcactccagcctgggcaacaagagcgaaattccatctcaaaaaaaaaaaaaaaaaagaaagaaagaaaagaaaccaagaagcttctagtctgacatcaggaaggtagaggacaggatttgcaagagcatcagtggtggcagaagacagcgaggagagagtcaccaggagtccagccgaatgaggagccctgtattagagaaataaaacctagaggatgtgtgtctcccctctcccccttcctcctcctccccgcctcctctcttattttaactggtgacaccattgtggggcagactggcagctgcagatccagggatccaagaaagctgatgttgcggtcttgagattgagggcagtctaaaagcagaattccttttttcttgggggactttagtctttttctcttaaggccaccaactgattggatgatgcctacccacattatgcaggctaatctgctttattcagaatctactgatttaaatgttaatcaacatctaaaaactattcacaacaatgtctagactgatgtcttacaaaaataaactgggcaccacagtcaagccaagtcgacacttaaaattaaccatcagaagccccagtgtagattctcagcctagcccataaggagggccaggagggcaggtcatctcctcccacagtgtggacatgacccggggtacctagaatagaggtgaaggactgcaagaggaatgtggagttcagaaccctgtgatgccattagctagttttgttttgggcctgagggcggtgagcccttttacctttccagcctgagttttctgctgggtgaagtgagagcacttgtagagacatgatgagtcacgggcgaaaggactgtgttcttttttctcgtggcaccctttttgaagcaaaatctcatgtgaaatccaaacctccccaaacagagttcaaagtaccttgtctaaatgaatggttggggcaaggactgtaaccacccaagggctttaccttgcctgctgcctagacagagccgattcatcaagacaggggaattgcaatggagaaagagtaattcacacagagccggctgtgcgggagaccagagttttattattactcaagtcagtctccccgagcattcagggagcagagtttttaaggataacttggtgggaggggcgacgccagtgagccaggagttagggttaaaatcataggaagttgaagctgtctttttgcgctgagtcagttcctgggtgggggccgcaagatcagatgagccagttgattgatctggttggtgccagctgatccatcaagggcaggcaaaatatctcaagcactgatcttaggagcagttcagggaaggttaaaatcttggtcacctctatctgcatgactcctaaaccataatttttaattttgtggcggatgttagtcctacaaaagcaatctagtccccaggcaagaaggagaggtctgctttgggacagggctgttactgtctttgtttaaaccataaactataaactaagtttctcccaaagttagttcagcctatgcccaggaatgaacaaggacagcttggaggttacaagcaagatgaagtcagttaagttagatctctttcactgtctcagttataattttgcaaaggcggtttcaatcccttcctttgggttttataacatcttaattttaaggtataggctatgaagacaggaaatggccattgatcgctttgacttcttcctgcttacaggggacgtagtgggaatgggagtgaaccccaaggtgagaagcgtgtaaccgctttgtaattgtgtgagcgtgctcatgcagccctggttgagcttccaaggcttgcagggcaaacattagtatttttatttatagtgttactacagtgtttaagtgaacagcctactataaggtaaataacaagtcctaggatgaggagtacaaatttcgattttaaaagcaaagatttgaaaacattagtttggggattttaacctgcacataatttagaatttagtttaaactgcagaaaaagccttaagaacagctaacaacagtgtactatagtttttcttttgaagcataatttttttctttagtccccatttttattaaaaacaaatcatgatagaactgatttgtttacaaaataaactttagtctttctgtacttggcctgattatttgcatgaagtgtagcaagaatgattattttttacttaggctttttaaattggctttgatagaactttattctatgaagaattttagataagactttttgaaagtcgagcctagccatggtttgtatccttaaatatctacgagttgggcaaattccttttctctggaggtcctaagataatctggggttcctaggcctgttagaaagtgatattttttatttaccacaggtcaggaaccttgtacagggactctgtgtggacaaggtatgaggccagatgccgtaacgggctttaattggctctgtaagtcaactttgattctttaaaggaaccatgccatttcagtcaaagccttaataaaataaccaagttttttttttttttgagacggactctcgctctgttgcccaggctggagtgcagtggcacgatctcgactcactgcaagctccacctcccgggttcacgccattctcccgcctcagcctcccaagtagctgggactccaggtgcctgccaccatgcccagctgattttttgtatttttagtgcagacgggatttcaccatattagctaggatggtctcaatctcctgacctcgtgatctgccctccacagccttccaaagtgctggaattacaggcgtgagccactgcgtccggccaagaaaacagatttttattgtaatatgcaattaactatactgccataaattgggaatacttacaaatagtttttaaattctggagaaataaggtagagaggaacaaaatatgctttaagttttgtttacaggagcatattttacttgttaaaagttgcaaatagctttaaagaaataagtttttttgacttagaaaacaaaaggtttagcaatgtttaatgcattagctttttatgagagtccaagaagttttttttttaattccagtagcacaatttttaaagttatttgagagctgcacatagagccttatatttgattataaactgccttttgaaaaggaccaaagcaagacaaaatatctgtggatgacaagtctgtagctattattaaagctataatggactaggaattttggttacttctgtggcatgcaacaattttacataattataattattgataatgtacactaaattatattaacattacagaatttttctataattttggaatatatataataacatatttatacaaatacagtccaaagaaaaccaaacaccattcactcttttatttgaacaggttttttattctaatgttataattttccaaagttatttatcagaaacccacatttaagagcacctgttaaattttatagctgattatacaattattttttaaagaggaccaaagtgagacaataactgtctgtggatgacagaaacattttagagcagccacagttaaagtcacaattgatgaggaaatttacctctgtggcacatagtcatttaacataataattgtaattattactgataacatatagtaagtcatattagaattatagcagttttacataattttggaatatataccaataacacatttacacaagtatagaccaaagaacgctaaacgccgttttatatttgacaatgctttctgtttgatttttgtaccaaataagccaaatgccatttttagactttagaggacctaatatctaaaatattaggtttgaaagagacatgatttaaaatttgattttggaaagtttgttaaatattaaaggtttaaaacactggatatcacgaaatagaattccaggtcaccataaccaaagttattcatttggccaaaatggtaactccaaaaaaatttttaaaacagaaaaccggctgggcgcggtggctcaagcctgtaatcccagcactttgggaggccgaggcgggcggaacacgaggtcaggagatcgagactatcctggctaacccggtgaaaccccgtctctactaaaaatacaaaaaaaaattagcgggcgtggtggcgggcacctgtagtcccagctactcgggaggctgaggcaggagaatggcgggtgaacccgggaggcggagcttgcagtgagccgagatccactcactgccctccagcctgggtgacagagagagactccgtctcaaaaaaaaaaaaaagagaaaaccttttctctgatagaggagactcagctttccaaacaggacccaatagagatagcatgaggccaactaaatttgtctcttttcttttctcccttttttccttgccatttacccaaaggagaaaataaaacccttttattattttttaacattacataaaaatcgtctttgaaagagaaaagtaaatttcatgtttgtattagtgaatttttaatgttaaggctagttttttaaatacaattttatatctgttcagttttaattaatttgaccataaggtaagatttttataaactttttagaaccctttacaattttccatcaaatagtagattaattttttaagaaaaccctgttatttggacacatgggcccagattctggccccataacagtatcattttagtgttttaacctatggaaaaaagctaaataattttttttaaatcttagccaacttgtttagacccacagaattttttaataagataaacgcattacaaaccctttcactttgcttgaacttctagttttgtttcattactcttttaggttaagacaatctttaagaccctctgaactagtcaaaattatattccctctaacaaaagccatattcctgtgcctttttataatcttttaacaaaaacacgttttacacaccttgcatgtaaaactgtttctccagttgtcttaattgtatgttataatgttaacttttagcaacttttatttttagtgaaaaacttgataagtaagtgatttttaactatataccggggtggatcctaggacgtcagacagaaatgaagataaggtttgactgttttcagcatagctagcgggcatagctcttcgtatgtccccaggccttatttataatctaatgctccaaagtaggtaaatcaaacaattttcaaaagttaaagaaacactttgaccttaaagcatttagcaaatcggatatctgaccttcatttagaccaaatgtttacattttcaagacattttattttactaataatttttaaaactgtccttatttccaaaagatgaccgaggtcatgtgaacaaaacggcattaaagtttttatttttctgacaaaatatttgacttaagtgctttttttaagccaattaatcagagcttttttatatataaacatcacccacacacacaacacatatacatacaggcagacagaagattcggcacttagaagatttttcatttgccagttttgtaattggattactggcttaagggtggagcgcttggagcaacagggctaggaaagcatgcatttctagggccaaagaagcagcaagtaagcagctgaaggcaaagacagatccccaaaattaggcgtgccattttatactggatcctggatccccaaaaggagggaaataactccaggagaagacagtgcggtgcagctactctgcatttcattgcatggcaactcaaagcccatcagcccattttgtaatcagccccttcaccggagtctcatctcccagtcgcgggcgaggatgtttccttgtcttccaggtggctgagagcatgcttctccgatccaggtgtgcaaagagtcaagtatccctccataactattattagcaatcccttgaagtatatttcctacctagttattacacaccaaagttctttcataatgcgaagtaatttctgatacccccaaaactcaaaaccgtcagatatcacagtgcaaaacagaacagtgcctttgattttgagagggatttatccgcttttaattcctggggtttcatgaggaaaacagaggtttttgttttttttcccaaaatggggcctgcggtgccttctgtttttcccaatgagttccaggctaccagaagttatcttaggacctcttacatgtgtgttaagagtggcaagatgaaaaaaaaaaaaatggagaaaaataattcaattgactgagaagaaaaaacttttttctagaaaaacaagttccaagaagagaaaaacctaaaggccttttaaatatatctatagtttgtttatccacttttaattaagctggcttttaatcatagtgtttaaaaaaaaatccttaaaaatttttttattacccaactttagccacgccaagcagccaatatttttggcttttgaattttaccacaggtaacgtcccacatgaaattaatcagttttactttactaatttgcataattactttaatgatttacataattaaggttataacttaaccatggacacataggtgtcttaaagagatggtgagcagtttcttttttttctctctcttttttttcttttacaagatttagaatgtcccccagggtagtttagagaaaggaaaatttaagactgcgaatcagaagctaataggggggaaaacctcaataaatggcaaagttacataagtaaaaaaccggaaaggaatcattccggaagccaagaatagaacccaggctgctactgtcaaaaagcaaagccttagctactgagtcggagagcagtgagcagtttctattgctcctcccagaaggagcctagagaagccagtttcaagcttgcaatggcttttaactgcttaagataatttttagggctatgacatggacctcaaaattcctgtcctctggatggcggaaaccaagagaaagtatccccacatagtcacaaggttaagctcttaaggacacagaacaagacagaggaatttcatacagtatttattggtttcagagacctgtagcaaagtttgtaactgaccagcctgctgcaagcttatgggggtcttaaacccacattctatcctgtgatactcctttctccattatagaacacagaaaagcaaattcttagcacaaagtacaccagatttgctaccgcctaagacgagtctcacaaatcctttttctgttcatcaaacccttgcagagagacaagtagtgacatttactgtttacccagacagagagagagggggggggtccagaaacttggctggtaggaatttcttacccttttttgccagcataccaggtttccgggctccctttctctgcagcttcctgaagaatggagtggcttctgatgaccctgctcaccgcaccatagctgtggggttcaagccacgcgtttttttttttttttttttttttttttgagaaggagtcttctcaaaacttctgtcacccaggttggagtgtggtggcacaatctcagcgcactgcaacctccgcctcctgggttcaagcgattctcctgcctcagcctcctgagtagctgggattacaggtgtccaccaccacgcctggataatatttgtatttttagtagagacagggtttcaccatgttggccaggctggtttcgaactactgacctcaagtgatccgccagcctcagtcccccaaagagctgggattacaggcgtaagccacgacaccaggcccttcaagccactttaccagagacaatcaccctttcctgttttatggaaccatatgcaagattcttaatttgcaagatgctgcccagtgggctgcaggggagatcaaattaacattttccattccagcaaaacacacataacaaaacaaacattagtcaccttgttcggcaccaagtattaacctggcaaagctcaaactttttcccgttggtccctgttgtctttgattcattccaggtgggaagggacgacctccaaacggtaattcacaatggggtctctgggcaaggcaaagagcagatagttacccagagagacaggcctgttgagccttctttaggactcattgaatgtgaccagacaaataaggagggttctctgagttagccatgctggatttccatcagcaaccccttctgagatcccttccacatatacaaacacacacaaagacgagacagacagaaggccttccaaatcagatccctaaccaagaactccaagagtatcccttccaaatgattgtcctattctccgtctgagaaacctcctcaaaatcttcctggttgagaagtctcccaaaccaggactcttcctactacttagaaagagccaaccaagatcccccaggagctgaacagacaccccacaatggggctatagacagacaccccatagtggagctacaaagagacaccctgcagtgaggctacaaacaccccaccatagggctacagaaccagtttggagaaggaaggaggcattggcagtgcctaggatactcaccaatccagacaccccgcaatggggctacagaaagacacccaccatggggctacagacagataccctgtcatagggctacagttaagggacgtcttcccaggactatttctccattgcaattaaatccatgcatattgggtcggcagcaccctgccagtagagagagtaccagagtccccagtccccagtccccagaactaggtggccgcttgggctggcttctggatccattgctggaggggagccactgaaccaggggcaggtagccacaaggacaatcccggacaagcccccaaatttgtaaccacccaaggggttcaccttgcgcactacctggacagagccgattcaacaagacaggggaattgcaatggagaaagagtaattcacacagagccgtctgtgtgggagactggagttttattgttactccaatcagtctccctgagcattcaggaatcagagtttttaaggataacttggtgggtggggggaagccagtgagccaggagtgttgattggtcagggatgaaatcataggaagttgaagctgtctttttgcgctgagtcagttcctgggtgggggccgcaagatcagatgagccagttgattgatctggttggtgccagctgatccgtcaagggcagggtctgcaaaatatctcaagcactgatcttaggagcagtttagagagggttaaaattttgtagcctcaaactgcataactcctaaaccataatttttaatttggtcgctaacattagtcctacagaagcaatctagtccccaggcatgaaggaggtctgcttgggaaagggctgttactgtctttgtttaaactataaactataaactaagtttctccaaaagttagttcagcccacacccaggaataaacaaggacagcttaaaggttaaaagcaagataaaagcagttaagttaaatctctttcactatctcagttataattttgcaaagacggtttcaggattggtcaccagctcccctgggcaggcctggcaactgtgaggaatgtgacttgaaaaccactgattggcatcattctaaccccgctcccctatcctagtttttttaagccactgaacctatatctgtcccaggatcaaagaatgacaaaattaagagcggaagtcctgttccttctaactgcaaaattctttttcttgatggaaagatgtttattttatccctgtttacattaatttgcctaaacacacatgttctgatacctagaaacaactttgcaatttaaaaacagagcattttgttagatctctcatttcttccattgctagagaaagttctaatgagagtgagggcagaattatagaactaagttgaacctacatgacagaaaatttaaattaaaaacaatttactatcagagtcttcatattggtgtttgtgtgtttgatttatttgcttgacacctacccacattatgcaggatatactgaattggttataattaccataatttataatatttaggtatgtatacttgagaaaggataccttgttctgaaattatgcaagggctaggtattgagaattatggacaattttctttactactgcaactctaagatatggtctctaaggatgaacttacagttgacaaagacaaatctgtgaaatattaaatgcataagttaagtgacagcttgaggcagcaaatatgggaaatcaggatggttattaaatgaattaggggttcggaatagggaaaatgaattcttcaggatgaggtgatctgggcttgcggtcaggtctagatatgagttgggagaagctttggaggcatctcaggagagtgtaaaagacaagcagacgtgtagcgtgggaaaggaacgtttaagggagagcaagctcctctcttttaaaggtaatgagaaaggtatgtttaaagttaagatacaagagattatggcccttaacagtatactgtgaatagaaaattataatgcagataatttataaaatacttcctaaggtggcataacatttttataagaaaattgttgggcttgcagggctgtaacccccattgtggacaacagacaagttaatgtcaaaatatagaagatttgattttagtgagctgacttgcattgcatgatcagctgtatgatgttaatagtaaatagtatatttagatatgtccatgtgaattccagtatttatggaatatttatctgaaattctgaaagatacactatcttagattttcccacataaccaatcattcttcccagagtaacatttatataaatttatatgtgtagcaaaacaacatgacttatagttatctagagtatccctcatcagaggagtattaagggtttttaagaagtgattattaagttataagcacttaaacttatatagaaagttatattcagagtatggccatctctcagaatggcttggtggattatcctgtattcatttcttatattcacacaaataaaactgttgtcatagtgtccttgttacccttttgcaaatttagcgacatacctttgccatttttagtaaggagattcatttatgctgacattgcagggtctgttgtagtcagctctgatgggtggaggttttgcagtgggatgggaagtgatgtactgctttatatccttttgttgatggtatattctatatgatttttactctattttttgcatatcattatttgctgtagaaatgtaaaatcctgagcgaataagaaacaattcacataattttgtttcagaatggaccaccaaatttggcagtgtaaaatgctgttacttattgctgtagacaaaatgaacactttcaaagttaattctgcatagctgaaattctttgacaacaaaataaattctggatactagtagaaaatttatggatttcaattagagtttgtagtgtgtcataattccagttttatattccatgcagttcagttttgggtttttaatggggccagtgcagtaataataaaaatgattcaaaatgcacccagtaattacagagatttgctgttgcgtttgcattaaaaatgatgatgatttatgctcggtgaaattgtggtctgtggctctatttagggcattcttgctattaagctgcttattagttatggtcagtgatttaaagcttaagacctacattagaggactgtaaaattatttattctttaatagataatagtaaatttgaagcagacattagattaattataatcttgtacattaacgaatacggattagtcctttgtctctttttaggtcttttgaaattcaagtaaatggaaaatgagttgattgagttagagagttcagtgaatttacttttgcctcctggtttgtaaatagttaacaccttttccaaatttctcattgtgggtccttctccacactaaacaaatgcaagttcttgcaataacttgtctttgttccatgttgacattccttaaattagctgaaaagatctgagagggaggctttttgcctgatttgggggcaggggctgtgggggatggaaatgtagttaaggataagcggactttaatttggcattgcagaagggagtttgtcattattcctattactagtaattatgtataaatttacatatatgtgtgtatatatttatactcaggtgcacacaagtacaaatgtgtgcatgtgtgtgtgtatatataaaacacagacacacacatatatacatacataaatcaggttatatacctttctttatattttatgtaagacagaaatcatctaatataaacatcaaagtgtattaggataggaatttcttgtaacattaattaaatttgatattcaaattcctgtgtaatgcttgggtgttatgctaaaacaagataaatatctaagagaaagagactgcatataaagctgttaaatcaaatgagaaaatatgtgggtattattcaggataaggtagggtatggtttaataagaaaatatctgccccacctccaacccccaaattcgaaaccttaacataataaatgcttatttctggctcctgcgaagtccttagggtctgtggaggctttcttccattcagtgactcaggggtccaagctccctccatctggtggcctatcatcttaaaacatgacctcttcagggacaagtgaagactggcgcaggatgatttttaagactgaggcctgggctgggcgcggtggctcacgcctgtaatcccagcactttgggaggccaaggcgggtggatcacctgaggttgggagttcgggaccagcctgaccaacgtggagaaatcccatctctactaaaaatacaaaaatttacctggtgtggtggcgcatgcctgtaatctcagctacttgggaggctgaggcaggagaatctcttgaacccaggaggtggagtttgcggtgagccagggtcgcgccactgcactccagcctgggcaacaagagcgaaactctgtctcaaaaaaaaaaaaatagagtgaggcctggaagtgacttctgttatttctgcttacatcccattgaccagagctccatcaagtggccccaacctatctgtaagagaccctgggaactaaagccttttttgtgtgtgtgctaagaaagaggaaaatcaaatggcattagatgaatacagagttttgtctgctgtagtatgtaaaatgcttctgaactctctgaatataatcatgtgaatttacaatcagaaaaatgccaaaaatgcatggcatcttttaaaaaatttcttgatatccccattcccttctgccctatgtgctaagaattggaaagaaaattagctggttgtatctagattcctatcactagtggcttggtacactgtagtttattctagttactctgcctctttctttctttagagtagttgatggcctcacctgagaataacaccatacagctgggcagcgttggcgtttcccattagtcggtcccactttgggtcctgcctttccatcactgacctcctccctctttcccctgttgaatgctcttttcttttgtgagaattaatggtgcacattctgaaggtgggaaagagtcattatttagctgtttaacagaacacctcggttgataaatttagttacatgttgcattagttttctattgctgcataataaatagccacaaacttagctgctaaaaataacatccatttattatctcatagttctgtgggtgagaattctgggcaagcctcaagcttgactggattctctgctcagagttgcagaaagccaaaattaaggtatcagccagccggggctcctatctggaggttctgggggcagaatccacttccaagctcatttagtttgttgggagaattccttgcagctacagacaggaggttcccgtttgctttgctggctgttagccatggtccactctcttgagctggaggctgccctcacttcttttcatgtggcgccttccatcttcaaaccagcaatggtgggttggatcttcgcagacttttaatttctctgacttattattttccagccagagaaacactatgactttaaagggctcaaggtattagattagaccaacccgagagaataatctcccttttgtcatgtactgtaagctcatcgtgggagcgccatctatcatatattcacaggctccacccacactcgaaacggaggggattacacaagaagaggaatcactggggtcattcttagaaatccgttgactgcgtttatttctgcccaagaaatatagcttaggaaggaagttttttcatggaacctgtagttttgcccaaatgcagaattgaaaagtaagaaatctttcttcaacaagaattagatactgataggggaagaggaggtggctgaagctggtggggagagaatatgaattttcttttaaaggcttcttgatatacagaaaatacttaaagagcaacttaatttaggtaatgggcatatagaatagtttacttccttgattttcaaattaagaacagcactcataaaatctcatttaataagttcaacaagaaaaaatataataatagccaattaagagaaagagatttagcggggagtgggaagtagagagacagcacagagggtaaaagccattcagagatcttaatagatgaacagtatcccttagaggataatgttgctaactattattaaaaatcaggttgtgattttatatgaatggtttaatagtttttgtacatgttgcctcctcagagagaccatcatttcggtaccccaccactcattatcatatcactctcttactgtctttctagaacgtggcagaatttgaaattgtctatgttacatgtctaattgtttattctctgcttcccaatttgaatacagaattatgtgttccctgttaactttaccccagaatgggaaatgcagagaaccaagtcctagtcccaggtctgtgactaacttgcttagaagtcaattcgtttgtgattctgagaacagaactcatctcaacatctatcaaatgaagaatgtacagtagaggaattagatgatttcaaatgcttctcccaaaggtatcctctatgccttttttccctttgtttccaaaatgatctgctttcttgattaggacttaatatttctaaaaatattgggtggtcatgtgctgaaagaaaagatggtgctgtgaaggaatttgcacagggttccctgaagtgaattgtttctcttacccttggctttctccccatgaaaatgaaggcagagtatgacagattgtatttctcctcttgaaatcacctttcttgcattgcccctccctgcaggagtattatgtgtcttaaccctttgaactctgacatgctttggttaatgaaaggtgagtagaagtgatgtggctctcttccaagcagaagctttacaaaactgtgcatggttcacaaattaaatcttttcccttagtcacaatgactggcagtgatcctggagtgaagaaaatggcacagaaccatagctgacccatactggatttgtagcatgagtgaaaaataaaacttcattgttgaaagccattgaaactgtgaggtcatttgttactgaagcagaactggcccatcctgactgataaacgcctgatacttgcgtgcaccagttcaaatcatcttggcctgaattcctattgcagccacggttgagcaaacagctctgcatgagtttcaaccagcatcacataggtgcaccctagcagctcattggtttaggcctgtgcttcttgctttcagtccagaggttcctctaactttgtcatgtactcctgtgggaactgactggcactcatacatgtatgaacaggaagtgcaaggatattaacatccatgagacaaaccttgacaaatgagtaatggaaggtgatggataaatgtttctctccttgttcttttttcatgcacagctctgagatgtatttcctaaggctcctggaaaggttttccataatagagcaacacatcaccaagcagccaaccccttcacacatcgcgtcggttttgggctttccttctttgtttcactcactccttccttttactctctaggatcacattcccaaataaactatctacatatgagcctttgcctcatgttttgtttactgggagaacatgactcatcaccagttagattctctttgaattgaaccaacttgaacattatccaccaccggagcaaattatgtacttctatagcatggaggattatactgtacatttatagtaacttgcagaacacaaacagtttgctacttagactggaagttattgttagatttgctgatttaaaaataagttctcccttcccccattaatcctctatcaaccggctattattaaaaagtcaaaaataggccatacgagatggctcatgcctgtaatccccacactgggggaggctaaggcaggaggatcacttgggcccaggattttgagactagcctgggcaacatagcaagacctttgtctctaaaaaaataaaaacattagatgggcatggtggcccacttgtagtttgagctacttgggaggctgaagaaaaaggattgcttgagcccaggagtttgaggttacagtgagccatgatcactgcactagagccggggcaacagaatgagactcttgtctctcttaaaacaaaaaggtcaaaaaatagcatgttgaagggaaagggaacatttatactctgttggtgggaatgtaaattagtacaatctctatggaaaacagtacagagatttcttaaataattaaaaatagaactaccatttgatccagcaatcctgctactggatatttacccaaaggaaaagaaattattatattaaaagatacctgaactcatatgtttatcacagcactattcgcaatagcaaagatatggaatcaacctaagtatccatcaatggatgactagattaaaaaaatgtggtatatatacacaatggaataccattcggccatataaaagagtgaaattatgtcttttgcagcaatatagatggaactggaggccattatgttaagttaaactattcagaaacagaaagtcaaaaccagcatgttctcacttttgaggtgagggctaaagaatgtgtacaatagacctagaatgtggaataacagacattggagactcagaagggtgtgaggtgggcagaggtgagggatgagaaattacttaatgggaacaatgtacattattggggtcaccgttagactaaaaatgcccagacttgactgctactcaatatatccgtgtaacaaaactgcacttatacctcttatatttatatatatatataaaccctcccattattagttctcagtccatcctggtgccataacacacagattttcgttgtgaggcatccatgttttttgacattcagtgattgaatagcatgttgttagacacaaatttcaaatgtggaagcacagtagaggggttgggatagctgtcattctgtaataccttgctgcccttccactcgaagttctcagaccactgacagcgccctggggcacagttcagttgttaggtgccaggagaaatactgtttcatttaggaattgaattggccaaattctcatagtgtctaggctctgttccctttttgcctcctcatcagtctattccctaaaaatcataaaattacagcatgatagaaccgggtcttaaaataatctagctaactcccttatttcataggtcaaaaaacaagaggttaaggaaaatgctctactttgtggggtgaaggagagaaattaagggggaatgtaattttggctgttaaggaaataccattttcttttaacgtaattaagttcttgattgtgatgctcttaaatgaaccatgaaattctaagcacttaccatgcgagtgtgatttttaactaagcctttttttttctacccccaatctgaatgttaaggtggcagatgcataactaatcttagctgaatctatattaagaaatcagcaaggtgtctttatttaacttccatgatgtgtgaatataatgtaatgttgaatagcatgattttgcacattatgtcctaaaataaaaacaactcccttaaagtgatagtaaaatgcagtaatgtgaaaggttattttttattcgatctcaaacgaaatgaaaagcacagaagaaaagaattggagaccttattcttaaatgtgattcttatatatatgttatatatatatatatatatatatatgtatatatgtattttaacattttaatttatatatatgtaatatttttaaacctgaaaaaccagtgtttgggtttgtattctatgtcacacagaggaagctcctatcagcagaagagaggttctaaaatccttgttatcggagtttaaattttctgaaaaatatcccacccgttgagcttctatgttcttgctctgggatgtttccatgggtctgtattagttccaggaaatttgggtcctttctattttatctctggaattgaggttcctgcagaaactacaagggattatctgtgttctttgctgtttaatgtctttgctgcagtgagacagattcctgaaggagtaaacaatgaaatgttttaaggctaactgtgggagattatgtggagaggaaatacagctattctgagagaagacatataaaatgttggcctgttgcttcttgaagtaatactgtaaagacctcttgcctgttgtacattaaccaatgcaagcatgttatagttgaagttgggattctggggttcacctttttctcagttaatgaatttttattttaatgtaattgaattttctttaagaatccaatttccacttcagaagataccattcccctgggaaagtggctcccaatccaaagaacatagacccttgaggaattaatacaagactcttggaacctatttgggcatcaaccattgtcagtgaacatctgcataaatagtgttttatataaacacatttgaaggtgttcttacatttttggtcacttttaaagcagtactttttctcaatcaaagggtagcaggaaaataagaaaagcctaacagtaaggtgactctgtgtgtgtgtttgtgcacatgcatacatatgcctgtgtggggcggggttgcggaggcgcagtctgtgtttttaaaaacaattaaagaggtctttatgctttaacaagctgagaactactatggtagttatgttctgtagggcatgcttcacaaagctaaatgaaaaattttaaagttaatgactaaacagtgcttaaagcatacacattattcatgatttattctaataacatttgtggatgactaacttaataatggtgctgaacatccattatgtttttgttctaaagatgtgtctaagtatctatgcctccttaggggtgggtttacatcactcagtgattgaactaagatatataattccatgtctttgtatagaacaggtactggaaaaatcaaccagttatataggcttccactgtgccagatactgttctaaacagtcttgtagatattagcccatttaatcctcatgataactctctgggatgtagggactgctgtggttcctattttgtagagggggaactgaagcggagaatggttaggttgggtaatatgcccaaggccatccatccaggaaatggcagagctggactttgaatccagagtctgagcagatcccttgccctgtcctgcttccatcagaggacttcatgtctgtcctggcaggaagggataggatgactgctggggaatacctagaggctggctggtttggtttgaggtagtatgcctcatgtgttctccactccctaaccccaactaccaaattgttttctctctttctgtatctttctctttctcatatacaatctcacatacctacaaccactctggacccacgctggacacgatgccataaggttaccttggacaatggctgagaggtcctttggtctgggctttgttcctaaaccttcccctaggaattgtcactgcataacacccagcatgaatgggtaaggtctccaatgcataatacaactcagtcctatttacgtgttttcctgctttaggtaacacatttgtgtttcttccgagttcatttggacaaggtcagtgtcttgagggttattcagatgactttataagcactgttcttttaaagcagttagccatggtctaacttgaaagccacatcacagcatgttttttttttctgaaaagtctgaaagtgttctttttcagccctgccaaaattggagacgaggtaatgggacggaaaacaacacgggtaccctggacttccttcattctggctgccactaaacatgtgtgttagtccattctcacactactttaaagaactgctcaagactgggtgattcaaaagggaaagagctttaattgactcacagaactgcagggctggggaggcctcaggaaacttacaattatggcagaaggcaaagcaaacatgtcctttttcacatggtggcaggaaggagaagtgctgagcaaaagggggaaaagccccttatgaaaccttcagatcctgcaggaactcactatcatgagaacaacagtacgggggtaaccacctctatgattcaattaccttccgctgggtccctcccatgatacatggggaattttgagaactagaatttaagataagttttgggtggggacacagccaaaccatatcaacatgcaaatgtgcctgggaaagaatcgctaaagaggatgacgctgttgtcttgcttccttgccccttccgattcatcaagtgaggtcgtggccagtggaggccaggcttcagtgtttggggaactgagcttggttgccaggaggccacaggctattttgatatggcaggctggctgcactcacaattgctgggtcacttcaaaagctcttgtgattggcaaggctggcaagcacagtccttcagagaagcatgttttttccaggcagagcagccatctttgcaaccccctcaccagacaggagagaaaagtcacctcaccttaatggcaggaaggttccagacttcccagttccttggactgagccagatgagagccagaagggtgaatgtggagcgattgctaggatggagctatcatttgaatgggcagaattctatttcagactgatgacttggttggacgcttgatgctgattttgtgatgcctaccttaacttcttgtatccagaagtggtatagagcagtagttctcaaagtgccgtccccaaggccctttcagggggtctgcaaggtaataattattgcataacaatactataatgtgatgttatttgcctctttcactgggagggcatttgtactggcagcacaaaagcaacagtggataaaaatgttaacgtcgacctgtgttagtacttactggattcttcacccatatgcacacccacatatacctgccaaaagaagcaatttttccttaaaatagccttgatgaagcagtagaaattaatgtttattaaatctccacctttgtgtacatgattttgaatattctgtgtaacaaaatgagaactactcataaagcacttctgttgcaaatggacgtgtatgtaaatcttgtctccttgcaaaccacttgtgctcttgtttgagttgctggctgaactggctgcattttccatgtaacaccattttcacttgaaagaacaactgagaacaagccatgcttatttagacttgggtatttggcagatttcttaaaaataactaaagtgaacctaatatttcaagaagcataattgacagtatctgttgctaatgatgaaatttgaatgttcaagtgaaaacaagaatttcagaaaacttatacttgccccagtgagtttgatagtttcatactgcctaaatattttttttgattaggctaccttgggtggtgatattaacacatggaatttttaaaatatattgaataatgatatgtgtcaacatttggaagatctgcgtaattcagaaactgaatattttccaaatgaccaatacatgataccataaaatcatgtatgggggaaaaagtcaatcaaaagttgaagattgaccaatgattttaatgtaataaacagtaagaaaagttcattgatatggtttcaaatttcacatggcaagtgacttttaagaaaccgccgcttgtcaagttttgccatggtattaaaatgaatatctacaattatttatctgaaaagtctgttcagatactccctactttttcaatgatacttctctgtgaggtcagatgtgcttcatatacttcaattaaaaacatattgccacagattgaatatagagagatataaagagacatacagagatatgcacaaatgtaaaacaatgccattcttcttaattttggggagaatatatgtttatttttcacaaaaatatttgtgttaatatgtaatgcatttactagtgttattattatttttttttttttgagatggagtcttgctctgtcgcccaggctggagtgcagtggtgtgatcttggctcactgaaagctccgcctcttgggctcatgccattctcccgcctcagcctcccgagtagctgggactacaggcgcctgccaccacgcccggctaattttttgtatctttagtagagacggggtttcaccgtgttaaccaggatggtctcgatctcctgacctcgtgatccacctgcctcagcctcccaaagtgctgggattacaggcgtgagccaccgtgcccggctactagtgttatttttaaatgaattaaatatgtattttaaatatttcacagttacaatttaaaacacagtacatatcaatagttataacccataaaacaaagctatttggaatcttcagtaatttttaagaattcaaatggctcttagaaccaaaaccagagaatggccgggatacaacattgcagtgttctcaagtggaggtttctgagctgtcatgaaattacaaaaagtttcccaggttgggaatagtgacttttcattatatagttttaaatacatcagagacaattacttaaataattttatctttaaaatgaaaactttgtagagctcaaatatgcttacatcacatattaaactctcattcttcaataactgatataaaaacaaaaatactggcaattattttcaattttaatttatcagaaataaattatatctacaacgatagtatgttatttatagagcaatgcttgaaagtggccactaaaaccttctctcttgtcttgcaatttaaaataaatcacaaatattcaagtaaataataaataaaccagcggatattttgagcaaaagaaaaacagtagttctgtatgttgactgttttctagttttgatgctgtaaccaatagttaaatctcagtctgcatattaatatacatggagtcaacatataaacatatagtttttaatgtattttaacaaatcatatttttcatacataatttaaagtttgcatcatttattgaataggaagaagtcaaactttttcattatgacattaaatataactaaataagcatcatgcataacattttatattctgaataaaaataaaatacttttgtctaaaatcacctttgtatcaatgaagggattaaaaaacatttctaataacatttaaaattctatctttcctgcaaaggagcctatgttttctagggcttgtaacaaaataataccaactgtgtgttaaaacaacagaagtttgttttctcacagttcacagccagaagtctgaaatcaacgtgtcagcaaggccatgctgcctccagagcctctaggggagactctttccttgtcttttccagcttccagtggcttctggcattccttggcttgtggctgcaccactccactctctgcttccactttcacctggcctcttgttggtatgtccctgtgtcctctcctctcctttccttgtgagaacaccagggattagattcagggcccaccctaaatccaggataatttcatcttgagatccttaattaagaacatctgcagagactctatttccaaataaggtcacattctgaggttccaggtggatgtgaattttgtgaggggggacactattcaaccattacagtttcccaacataaaatgattgcagagcatagaagtagttttgataaagtgggctttgctgttgcacagacccaccctgccactgattagcagtttgaccctggtaggttgtctacactttaaagcctcagattcttcatttataaagttgggtctaggatcgccatcacattggcttgtggtaagcagtaaaggtgattatgtaaaagtgtacgttcacatcacagtccctgggaggtaggcacagagggagttcactcagtaaatattagcagccgtttgctgctgttgctggagcaggcaggtaataataatcatagtatgttctataagcataccgtcatggcaattatattggtgataattgaagtatgagttagcagattaatgttaatggtgatttcaaagacaattagtatacaataatagatgattttcctgtggaataggttgatgagagacagagacagaaggagggagagaatgagaacttcaagtgagcagcccaggagcctgatgagagccaggcaacagaagtgttgtatccaaagacccaccatattttaacgaactgcagtagaggccagacactggcgttcagcacactccagcatttatggctatttctgttctgggcttgtgctgcgtaattataaggcctgtgtcttgatcacattttggatggtattcggagaacctgaatcacaagacagaggaaaaatctaaaggcatctatcactgtgattccagacaatccaatctaaacctgccctcctgcagctgtcaaattgatttcctgtcacagctctcttggtggctattttcgaatctcccccccgtcctcctagaaactctgcccttgcccctctcatgggctcttctgcaggtagctttggcccatcagaactgagaagtggtccgtggcacagtcccgccctccctcactcacctccaaatgtgtgggcccactgacccatctgtcttcattccttctgattttgatgagaaattaccccactcccctttaaggctaactcccacctcatctactccgacccaggtgataattatggttcataattatccctttgttttttgcatttagtctgtctccatggaatccttccactccgcctgaaaatatgcccaagctccctcttcgttcttaaaatcgctgtcctttccaactaccaaatacctccttaatcgttctattaaacttcttgaaagagtggtgacctagcccccacttcttgttgtgatcagctgttaattattaaataatggttgaaagtacagtacagaattcccaacagttaaattcccggtcatttcttcctgattgagataaggcacggccctgactccaggcggtaaggcggcactggcctcagaagcaactgtctctgggtgcactggcggcagcctgcagaccacagccctgtggggtgttcttttgtgtaggaagttggcattctcagaagcgtcagtgatgagtacagcaaagtacttttaagaaagtagggaatttgcatagctatgcagttggaaaaattataaaatcggttaatgccccaggatagcataaacaaagaggcttttgtttttttaactctgaatttgtttctgatagtttttttctgaagaaaaagcagtaggaaaatgtccagccagcctctccactatacttttcatttgctgaaagccgcagagaagtcatgaatgaaggttagaaaccgtgtagaagctgcagaaaagtcccgaatgaagtttagaacttgtgtggccctgaagaggcagcgagaagccctgaatttttctccaggaagtagagaaaattatttcacttactaaggacacacctcggaggaagacaggacagtgagaagagtttataattaggatgacatttgggtagttgcctctaaagtaaaaaaaagaaaatacatgtagatcataatgtggatcattctagagtaggccaaacatttttctcttctatagaatcttagaaaatgtaccctagaaaactctttaaatagaaaaagagcatatcaggacacgtgtgtatgccagctatttgtataacctaacattgcatccttcagcctgttggggttctggagccagcctgagccttccccattgtagaagccgaagaggagatgcttagaggaaagatgattgttaagacacatatgggctcagtgaacatatgttatcatgttttctttattgtgtaggcaataaagactatctgactttctagactaaacttttccaataggaacttagtttagtgaaaaatttttgtgaaaattatagtagggacgattcaatcggtcagcagtagtagtggctgacattacatataatgctcctataggagatatgaacaaatgtaaaatgtgggggttttgcccttggagaaatttacagttacagtgaggctctccatgcaaattcccacctttcttggtcctatagtaacagccagtgtaacgtagctgaatgttggaaaactgaagttgagttatgtcatgaggtcaaaaaatcttgtgtcttgtcaccaaccacccaaaggctctgctttgtgcccctgtgttacccagaaggatggaaagcaacactcctactgtcatcaatttttttgttacacagttgtctcccaaattgtatgcaaatttcatactattaatatacagtcaccggttatatttcttcagcaaccaaatatggaaaatgtgtgtcaactggttctacagctgcaattgagctacatcctttagaataatgtcacaatagagaaatgacttctgaatggtgtttagcctgcatatcactctgattgcctttaattaggaggaaaatcacaagctaaaaagagtaacagacttgaagtcagttaaaaatcagagtaatcaactgagaaaaaaatgcaatctcataaatcttaatttttaaccataggataatagtttctttattcattgaataacttttactgcctctccctgcttctcagattagaattctaacactgataggagatttggcataggagaactgcctagcctctgaaatgaaaggcccctcaaaccccataaaagcctagaacaaatgaaactgagaaagtcacaacccaagaattaggtttgggtggcttgaatgtaagaacttcctgattgagagtggtctcaaagtcaaagggggagaatagactaactgtgatgtaaaccttttagcaatgttttcctagaaatagggagataataatttggcacactacaaagaaacttctggcaatcactttaaaaaacaacaataacaaaaccttgtctttaaaaatgcaaaatgttaggggtgttaagacaccaaaatataacttggtatttattcctgcagaggttggcttttatgaatttatttatttatttatttattttgagacggagtctctgtcaccaggctggagtgcagtgcctgatctcggctcactgcaacctccagctcccggattcaagccattctcctgcctcagcctcctgagtagctgggactacaggcacgtgccaccacgcccagctaatttttgtatttttagtagagacagggtttcaccattttggccaggatggtctcgatctcctaacctaccttgtgatctgcctgcctcggactcccaaagtgctgggattacaggcgtgagccactgtgcctggctggctttcatgaattttaagaagggatcaatgcctttcatgatttttaagtcaacctagtatgataaccgagaaagaagactgtgaacacatgtgaatagattatttttcttggtggagtgaagaaagagcttttattttcttcataggggtgtgcctaataattaagggggaaaatgaaatatgagaaatgtgtgatacgtatggggacagctctgtaatagttgtcttcagcagttacctccttcaagcttgtcagaattttaaaaccgttcatttctgttccacttgaagagtgagatctatcaagaccagcctctggagtgccacaatgtgatcagccagaaaagaatgacggcgcattcggcacagggaaatcactgacgtttcctatggtcatgaagcaacatatgctccactaattactgttttctgtgactgctctcacatcttgaaactctccatgacccattgcggaaatcctgttcatctgccccccacctactccctcagtgaatgaaaaatagcagattgcaaggctggacttgtttaatgaatgtgatttgtttttgtggaatcagaggcatgagaggttttggaggctgttagtttgacactagatttgtgaaatgacttcatagtccacaccgttagatgggtttataggcagggtgtctttacttgctaaatgataatctgtccaaaggcattttctttatttttctatgtttctagagcaaagtgacctttgaaggaaggcagcatcatgtctctgacttcaggcagaagtctgttgaacatggggcagacatggaatcttgcattataatgagaatgtcttcaagaaaagcggactccctctgtggccttttcttctcttggaagtagtcttgttgccatctgagtgacccctaacactataacctaaggattttcctggattttttttctgacacaaatagcttgttttcttgtactgtatagtaaatgcaatttttggtgttaacacctttttatgtattcatttattagagcattaaaaaccaaagtgttggccgggtgtggtggctcacgcctgtaatcccagcactttgggaggctgaggcgggtggatcacgaggtcaggagatcaagaccatcctggctaacacggtgaaactccgtctctactaaaaatacaaaaaattagccgggcttggtggcgggcgcctgtagtcccagctattcgggaggctgaggcaggagaatggcgtgaacccgggaggcggagcttgcagtgagccgagatcgcaccactgcactccagcctgggagacagagcgagactccgtctcaaaaaaaaataaataaataaataaaacccaaagtgttaccttgtttatattcaggtaacttcccttctctatggaattttccctcactcctccttcctccccacaaaagcccaacaacttggtttgttcagataggttgaagattactttttcgcagtttataacaagagctgatgtttaatagaggtattgggttgcatatggctttattttggcgactatttgaatatattaaatagtagtaggatatcgttacttagtattacagcaaaataggatgattctctggagaaagaaacttcgtaagcctggatagtaatacttaccatctatttagatgtgattgcctgatggtgtcacccaaactaattaataatgacatattagctaacatattgccgtcagcaggtggctgtttgagcaggggtgaaaatggcaggtgctaaaacaaattgctgtaccttagagaaatgtacagaattcttcttttaaagagtcttgatgatgtctgcagtatgatttttattttttgggagcttacaaggcttggagaggttgcagagatagagactaggaaaacaaaacaaaacaaaggagaacaaaattgatttaaccttttccaaaagttttccaattcaataagcaagcggttgaatctaagcagcacaaaatttccaggaaagactcaggcatccttcttccttccaactttccttttcttcctcttctttgtccatctagatctgtcaagggattgtgggcacacagcagagccatgacagatgggcagtgcactgtaatctactgctgcctttcaatttcagagggatcattgtgacaatgaaggggttaaaactgtcaacacctatcagagcttggagataattagtgtaatataaacccaagaactttgatggcaaagaccacacagcaaatgaattcgactaggttgctgctttgtaagaaatacttaattaacctctttccagctcacgtgcaactatggtttttacatgcctatgtgaaaaagttactgtttatacatacagatgataatgattaaatatgactgtgaatcatttttactttggaagatgcatttcaaactagcacttgcagctacaagttgaaaagataagtgctcttccagcatgagataggtcgcctttggaatgtctcacaatgtattgactattgctctagtactaacgttgctaacgtgtagtactgagtaatgtgacttaggaatgcaaactattacaaggtatatttttatctaaccatttttttttaagtttccacctcttagaaggaacataaaaggaaaataaagtaggcctttttaaacaaaatataggcttgacaaggataaaatgcattcttttttaattagcttgaaagagaaaattgatagataacaagcaaaaactcttagggctgttcttcaaaagtccatgtggtaagcagaaagggacaagaatgacttaaaaataggagcagaaatccatgatggactaggggaagaatgggtaaaggagaacttcaataacccagatatgttcaaatccacaggtcccaatggctggcatcctagagtacttaatgaattggccgaagtcatcacagagccgctagatatcatttttgagacctcgtggaggactgatgaggtgcctgaagactggaaaagggcatatttagaaccttctttcaaaaagggaaatggatgatgaccctggaaatactcatcagcttaactttttgcttggacaaattctggaataatcaacttagtaaactgggtaactggcttataacagctagaaataaggcagtgaactatcacgcataaagaagtattgagttcatttttttaagaagatatcatgatgagatacagtcttatgcatttcttggcattctcccttccattcttaatgaaaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatcttttttttttttccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataagagaaagggattatttttaccatgaattgtatctggggacagttagtcttagaaggagtaattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcagatcatttgaggtcaggagtttgagaccagcctggccaacatggtgaaaccctgtgtctactaaaaatacaaaaaaaattagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcggttccgccttggcctcttttgtaatcttccacatcttgatgaatgtgatggagtttgtgcattgtttaaattgacaatatgtaaatatttatggtatgcattatggtcagcatgggaaatcagagttctaacgggaaagaaaggaaaaagtgggtcttgccacactgtacatcaaagtgaaataaatccatcttacgagctgggatcctttggtatggttgttatatgtgagtatgttgtcgccttctcttgtgtgattctgtgccagtcatggtggctcaccgcggtgggagatgggatggtgggggctgtcgggtggtaagaggggctgtgtgtggagtttctgtacatgtgtttctgctatggttcctacagccctgaatctctatcacctgaaatgtgttgtgattcaactacagataagcaatatttccgtgttcattagacgcagagtgctggatttgaatcccagccttactactttctggcctcaggacctttggcaaatggactaactactgtgcatgcttaacacagtcaccagtccccagacattaatttgaagaagttttatcacagtgttttgggttttatataaatgtcatcatgtgtaatgatttgatttttaatcaaatcatttaaatcaaatcatgtgcatgtttttattcccactggatgcaaaatgagaagaaagtaaatttaaagcaaaaaaaatatatggtaaatattaggagaaatatgtacaaatttgaattttagaaatgaaaaggaccttaaggataacctagtctgattcataaattgtgtagttaagagactaaggtgccaggagtgagtttgtggcatgcccatgataacaccccaggttggtggcagacgattggcgttcttccacatcctctaatcctggcttttgtctgatgtcaaatcctgggaagtatacctaaagggttctgtggctccttcaaaaaagactcatttttctagaatggacttagtttgaacttagatccctggtttttaagacatagtcatagcccttttgttcataaactaaagctccaagctgccccagggctctgcaggggccagcattgtggcttgaaaacctgatctttcagccttaaaaccttatgcttcaggtcctccttgatctgataagcatatttagaaaagttcacgatactggtggacagccctaaaatgtactttttaaaaatggggaaatgtatgcctgcagtaaagttcacaaataagtgtttgttaaagaataggatggtttatatcgttaatgaaatcacatcacgtaagtcagctttgaaaacatctttcatctgaatctagataatgaatatcttctagtttcattccaggccattcgctgtcccactgaggatttttttttaatttaaaagaggaatcttgaataattttaaatgaaaaacttactctacccgcaccccgcccccctgcccacctcctagagttaccctgaggacagagtacattcgtgtaattatggacacttttttgactaactcgtctattttaaagtacattcatgtaccaatgacaggatgtctgtggaatctcgtttgtttcttggctgaatgatgagcaccaattgtgaacactgtatattcagtgtacattgttttagatccctttagctcaatcaatttaacttcaacttcattttggaagttaattaatctacataatagcatttacaaaaatagccattttgagtgaagaatatacatttaatttaaaaaaatccttgcctataaatcagaagtccttaaatccagtctcttggttttcctggtgagcagagctgtctaagtcacttccttttacaccttcagtctcccatctgcaaaagtgctcagtggacagcattgctaaacacaccctgtgaaaggtttgagacacagatgggatctgtgagtaatttcaactttttttttttttttgatgacctccaccaggccatcagtacatctggtttgtcccactgggtttgttccccacttggtgcttccctcgttcctagtgtattatctggcatggtgcaggtgctcagtagtattgtagaatgaatgaaggactaagtgaactttctcataagcctgaagaaactgaatgttgaggttatgtgagatggttagacagggcatttcctattttcggggaacctgaaggaaccactgtggctttgtgttggaaggatagtggctttctcccctatacatgggaaaccaagtttctcctttttggaagttcactttatggtgtgattttgttattattcagattttctgactttcctgtttacttttgtataaaaccataaatgcaaataaaattcaaaaaataaaattttataaactcaattaggttttctgttgcagaaatgtagtaaacattgtaatttgtgaaagcacacgaaaaatactgaaatgacacagtgagacagggtctcaccctgtcaccctggctagagtgcagtggtatgatcgtggctcactgcaacctcaaacttctgggctcaagagatcctcccacctcagactcccaatgttgcactatttgaattaagattttctttagatcatatattcctactgtgaattatgagagggatatatgcaattaaaactaataatcaattgatttctgcaattatagctaatcaaactatagttaatgtacttaatcacatacatgttagtatatggtatactgccagacaaaataccaagacattttgatgtgtcttgcacaaaccctaatttccctcttagattacattttggacacatccccttttggatatatttgatataaatttgtgacccataattttgtccctggaaataattatttcttccccaaagggtacatctaccctgtaccaaagtaaaggcaaaaaagagtgaagtagttaagaacagtccagggtcattcagatctgactttgaatcccacaaagctgctgagaattacaattgcttgccttaagaatgagcttgcaactctgcagtcattatgtgtcttgttttccttttcttcctctgatatatacggattacatgggagccagaaatggacatgagagctttgaagtcacacaaacctggatacaaagccccgttcttcacacctggctgtgtatattagtccattctcacactgctataaagctactacctgagactgggtgatttataaaggaaagtggtttaattgactcacagttccacatggctgggaggcctcaggaaaattacaatcatggtggaaagtgaaggggaaagcaaggactcacagggtggcaggagagagaagtgcaagcagaggaaatgccagatgcttataaaaccatcagatctcgtgagaactaactcactataatgagaacagcatcagggaaaccgcctccatgatccagccacctcccatgaggtccctcccttgacacatgggaattatagggattacaatttgagaagagatttgggtggggacacacagccaaactatgtcaccatgtgaccttacataagttactaaatcctttccagtctgttctgttatctgaaaagtgaggttactaatagccccatcagagggtttctgggaaaacttagcaaaatgaaatgtaagataatgatagaggattttgtattggaggaacacaagtccttactacatatcagctgggcagtagaatgtggagggtgggaacagaaaagaagtttgtgactcattaatgaaaattgttttcaagatatgctagaataaaagcgtacattcattgccaggcacggtggctcacgcctgtaattccagcattttgggaggccgaggagggcagatcatgaggtcaggagatcaagaccatcctggccaacgtggtgaaaccccatctctactaaaaaaacaaaaacaaaattagccgggcgtggtggcaggcacctgtagtcccagctactagggaggctgaggtgggagaatggcatgaacccaggaggcggagcttgcagtgagctgagatcgcgccactgcactccagcctgggcgatagagcgagactgtgtctcaaaaaaaaaaaacaaaaaacttacattcattactcaattacaaaacacaaacatcaaaaaatatggttgccaacactaaaaaaaaaattaatatgtgcccaggttaattcaaagcactttccatgtattatcccatttaatcttaagattattctcattctacagatgaggaatctgaggaaaagatgggtttttcataatttacccaatgtaacacagccagtaaccaagaaagttagaattggaatctcagcagtgtgactttaggcctgtcctcttaacctttatttatcttctgtagggactaaacttaatgcagaatcaaatgtaaggaccacatatcaagaagcaggacagtagaagattgacaaagttctcaaaaaagagggagtgcttgagggttgaggagaccagatgaaaatggtgtcttagtctgatttgtgctgctataacagaatgcctgagactgggtaaagaatagatatttattttctcacacttctggaggctgggaagtcctagatcaagatgccagcaggttgggttgtctggtgagggttgcattctccagagaatgttggctgtgtcatcacatagcagaaggcagaagggtaagagactgaatgttttgtgaagcctcttttatgaggaacttaataccattactgagggagcacccctcatggcctactcatattttaaaggcctcacctcttaatactatcacattggcaacacctgaattttgaagggaacatattcaaactgtagcattctgtgtcagatatactgcatttcatcaaatctaagatgaaaagcaccaccagtaagtaccattaagaaaggagaatgctgccagtttaactatattaaaagtttacaatatgttttccatttagatttttattttcaacttactgatagagttatcttaggcttatttctacatagatatttatgatttatcagttgaacatacataacaatgaaagcaaagctaagtaaatgtaaggtaattctataggacttttgtaggcagtttcttctgaatcttttcaattcatgtccatctatggccctgttgtcctcacaggttctctggcccagggaggcattgctaaagtagcacttcagagagcccctctgtcatatctggatttcatccaaacctttctatgcatttatatgctggaactttcttgatctccccagaagctgtctgcagaaagttttcagacagtaactcattcttttctcaaatggccattaaatggtttcttggctcaaatgtgggttgcagctctgcatttgtgccaccacgaatggcagccatatttgtgtgtttgcacattgtggcaactgtatcaatagctgccagtcaaaattgactataattctccatctcctgttttcaactctggtttcatacgtgttaaatttgaaaatatgtgcattcaaatcaatgaaattacaaggaaattcggaccatccatttcattttaccaactgtcccttgactttgataatgatatattagtcattttgcgtgtaactgcctgagactcagaataagaatatcttttgatatattttgtagttgactctctgctaatattattctccagtgggtctctgacatgatttaccctgtggatacacaatacataccggttgtgtttggcttactgccattattctgtatttcatggagctccctggctcatggaaagtctttaaatcattatttagacatattttatagaatttagcaccttccctcatggaacaatatcaattttttattttattattttaatttttaataataatgcctgattatagcgttaccccttgcattaccaatacacacacccactactggaagcagagcaggagtttgttctcactgctggttcagggcaagaaatactatgttttcattagaattctaagtggcagctcaaaatttactatttggcctttaaatattagaattctgttaaaatattttaaactttttttttttttttgagatggagtcttactcctgttgcacaggctggagtgcagtggcacaatcttggctcactgcaacctctacctcccgggttcaagcaattctccttcctcagcctcttgagtagctgggattacaggcgtgcaccaccatgccgggctaatttttgtatttttagtagagacggggtttagccatttcggctaggctggtctcgaactcctgacctcaggtgatccacctgcctcggcctcaaagtgctaggattacaggcgtgagccactgtgcctgaccaaatattttcaagttttaagatgttttcaggagcttttagacttccattcctttatgctcagagtctgtgtggtacagtggaaagggggtggggctttgggaccagggagaaagtggcctcacactcttcactaccaggtggccttcattaaaaaataccaagtgctttcactagtcaaggcaagttatgtacaagtttcattcaatccttctagcaacccaataaacaattgttgttactgatccattttacaggtgaagaagctaaggcacagagagtttaagtaccttagaaaattaacttctgttatctgtgatgtccttagatttataaaacaaagacttgctatattagctgtaacatgcataaagcacactgcacatatttggtgactgaaatggaatctaattttattacactggtttttaattgcttttatcctccattccccaaggagtattaaattgccctttgaaatagccttacagattctaagaggaaaatacactttttagaattttaaaactggaataaaaataactttctattacacaatttgattctacctgttttgtcttatgtgattgataatcctcattttttaaaattaagaaaaccagtaggcagcttcataccaatgcccaggatttcctactgcctgcaaatcttctccttcatgcctaaattgaaggaatttgtacttcacagtgatgaaagtcttttttcagtggatctttgggtgaggcaagctaacatcgtctatacttttgtgaatcaataaccgtcttgctgaatgcataacttctagtagttcttatctttataaaacttccatgtccacattagaaatattccttttagaaaacgtttgtcattgcccctaccaatacaaagaagagtaatatttatacacatgtttaaaagagaagttaattcaataatttgataggtgtaattaattaaggcatagttttggagaaacattacaataattgcctcaaatttttgagcctgtctgtcctcctttcttctttccctcattcctttctttctttctttttttctctctttcctttttggaacctacaactaaatgaattgaatatatctcttttagcctacaaatcctattcatctgcttttatttttctatgctttaatatccttccaagtacatttgaagaataagtaaatatattttctaaaaatcttggcacatttcctggttttgaaggcatgaggagagagttggcaaaaaagtgatttttgaatgaaaataaatctatccttacacttaaaatccccagaggcatcattgatataaaccaaaatagccattttcataaggaaaatagccaggttttatgtacttttgatgatagagtgtttttaaaaaggctgtagcaactgaatatatatgtaaatctagtgtatagtatttccacatcacaaaccatagcataacctaaaccaataattggaaaagaataaaccaatgaaagctatattctagaatcaggtacactattacaaaagttcagtctaccaaaataacagatctgttaaatgcaattttaggaacaaggcaaagcttcttactctgccatgcaatggagagaagtcgaaatgcatttacaaagctcactttccaaagttatatatagtagagagaatcaagaaggataagaaagagccatgcatttagtttactgtccatcagaagaggtttctctctactttataaattttttgaatcttgcctttgaattttttgactctaattattagttgcttaaaagttattttgataccatgctatttagttgtgttgttagtagaatgttctgtttctctctctcgtataatttacctgacttcataaacaggaaataatgttgagcaactaacgtgtcatacccatttccattcccacatccttgaagaagagtgatcctaagttacaataaaaacatgctctgactaatgcttctctctgttcacttttgtagatagtgagggagctttaaaaatcacatcagttattaaaaattccatgagaatatgtctttataataagggatgaatttgttctttttgttattcataaataatcctgaaggattatctaattgcagaaaacaattaattttccctttaatggttaaattgattatagtagacatggagaatgataaatgtcagtaggttgtaggtcatgttaggtactaaaatgcctaaaaaacaatttggtgttcataatcataggcaaatatatggcaggtgttaaaagttgtttgtgggtaataatcatttatatttcatacagaacatcaaaagtaatatctgcgaagtaaaaaaaaaaaacccaatctatatttgttacatatgatgaaacacactgcttcaaaggaaagaagagttagacatgggtttgaatttcattctgccacctaagtccacgtggtcttgggcaagttacattgcctgcctcaggataatataaataatttacctagttctatgcgtagtaaatgttcagtaggtgttagctatcatcatcataattcatttacatatttgacaaatattaagactgtatgatgaatcaagtcctgacaaattcctaaacaatccagtttgagaacaactgattgagcagtatgccctgcaggtactgcattggtctctgagggaacacaaggaggaatgaataaaggatttaccataagtaagaggagatagccatgcagagaacttaatctctatcaaaacagagtggcaccagtgtcaaataaattcctgatacatgcttacatactgggaaagtaaagagaagatgtatataactgagatgaacagtcttaaaagattggtaggattttgatgagcataaagggacaagagtgcaaggtgttttgtggaagaaaagtgattggccagtggctttgcagtctaggctgaggagaagaataaaagcgaagatatgcctgcgatagtttggaagcaggctttgaatttttttttttttttttttttttttttttgagacggagtctcactctgcagtgcaggctaaagtgcagcagtgtgatctcagctcactgcaacctctccctcccaagttcaagcaattctcctgcctcagtttctcgtgtagctgggactacaggcatatgcctggttaattttcatatttatagtagagacgggttccaccatgttggccaggctggtcttgaattcctggcctcaggtgatccacctgcctcggcctccaaaagtgctgggattacaggcatgagccactgaatcagggccctgccctgaattcttaaatgttatacttggagggcatattttattttataggctgggtattttccaactttctttaggcttatgaatgatgcccaacatattttcatgcaacaaatatgtgtggaatccttactctgtgccaggcgctgttgtaaatgttagaacaaactagatttaactcctatcatcatggagattttctttctagagaaatatagtgtgggcaattgaatgctggctactactttctccttcacgcaggag

SEQ ID NO: 352 - DNA, 69583 bp, Homo sapiens
ctctgccattccttttaaatttagcatagaggtattcggcaaccggatttgccaaatttctatcaaggaaatattaatccacataatgtcagcaaaacaacttgaaatctctccaggtaaatattgatgaatctctgagctttctgaagatgcaaacatctcagcagttgcttatagcctcatgaaatgcattctgttcaacacagaggcagctctccccaggaaacaagtgaacctttgtttgttctgtttatttgaggaatttattaagttggactctcccatgaaagtttgggtaggcacctagaaaaatattaacctttctctgaaaagaggctcaactcttggaatgcttcacacaaatgcattcattcttgggaaaataccagtttaaatcaggcacaaaaggtcagaatgctagaaccctcctgtgcatgccccaacttttttctttccttggaagtgtccccttcagttccaagcagaaaacttgaacccctcctgtgcacttactcctggctctagacattaataggcatacatacaataccatgccctaaagccactcacctttctctacgtagaaaactccagttaccaagcataagccttggctggtgtttaaatgtgcaccaggagatatcacactaggcaaggctttgtgtgaaaaggacttccagtttgaatgaggtagaaactggaagaaaacaagcaacgcagtgaaatcctgttgaccttcactgtaaccactaggatttgaagaatgaagtagtttgttctgtttaatccttaaaaagatccttcataggattgttcataaggatccttaaaatatccttcatgattagggaaagtacaatccctaactcatatgtctttggtgctctcttaacttgtccaagtgctcacatgtgcccactgccatgactgggcagttggaggcagatgatacaggtcagttttatccttccccacaaccttccatagaggtaaagaaaaggatacaagacagctagtcaggaaacctgggtgaccttaggcatcccatctctctgggtcttgtttttctcaacaatgctagatcagtgtttcccaaattttatcgatgattaaaatctcctagatggctttttaaaatacagattccaggcccttgctctaggaatattaatccatcagatcttggctagcaaccaggaatctttatactgtatgagcactcctaacccaaattagactatgagcagggaaggtttggaaaacactgaattagatgctgtaaaaactcctttccagatctagtgatggaagttttaggtggatcatctgaatttagcatggcagttgctatcagtccaactttctccatctttacccattcagaggacttaactgtgtggagcacattgagagcagctctttccaaggggattgcgggggaggtttgtaatcagcagcagtcaagcagctaattaaatatccagattatctggtaaatttgtgcttattccgtcctgcattgtaattcaccagctggctttattcaagtcttcaaaggtttgcagaaaatgtttcagcctataataataatatctctgaaattccaagactgacaaagataagacattataattatgcacacacgattatacatactttaataagcatgtgtgataagcaaattttataaatcactttcttctcctttgttgtgtctttagcctcaggcttctactttattctcaaaaagaataccatgggtagaagaactttacggtgttgaaaaaagaaacgaaagaaggacagaaagacaaaaaaaagacagaaggatgaaagaaagacagaaagacgaaagaaaaggaaagaaaaagaaagaaggaaagaaaggacaaagaaagaaagaaagagagaaggaaagaaaccacaccaaacctgttcatcactgtaatgattgagatttacaaaaaataaagtttcacactttttaatttagcatctacacagaaaaattgaaatttttaaaaggagtcttgacattaagaactcaatgatctctaacgatgtggtggatgaagtatgctgctcacccactgtattagtctaggttctctaaagggacagaaccaataagatacacacacacacacacacacacacacacacacacacacacatatatatataaaggggagtttattaagtagtattaactcacgagatcatgatgtcccacaataggctgtctgcaagctgaggagcaatgaagccagtctgagtcccaaagctgaagaacttggagtccagtgttcgagggcagtaaccatccagcacaggagaaagatgtaaactgggaggctaagccaatctagccttttcacatttttctacctgtttttatattctggccacactggcagctgattagacggtgctcacccagattaatggtgggtctgcctttcccagcccactgactcaaatgttaatctcctttggcaacaccctcagagacacatccaggatcaatactttgcatccttcgatccaatcaagttgacactccgtattaaccatcgcacccagccactgaagaaaaactgaaaatgttggatagactattttcaaactcttaaaagtgctctgatgcatggaccatttagtaaaagatactaagggtctcagctaagtgaaaacagaaatgcagagaggtaagtgtaggctggatctagtttctgctttgaaaatatttagcaaataaggtgaattttccttcaaatttcacagcattaagagagaaagcctaaggaggagtcccgtcaatgttagtggaatctagaaataataaagcccaagtgacttcattaaaaagtatctatttcaaactgaggtgcagatggaagagaaaaatcatctaacttaagaattcctaaccacaaattggccctcatacatgtttgctgtctgaattcattctaactggctgttaaacaaagcaaaacaaaaaaacctcagtctatgaatttagtttaaagttaccttgggcagataatgccatagacatctggtataagcaaatgcaaatcctctctggagaaattcaccttcagcctaggctttaaagtatttccatagaaaaagttccaagacttatgaatgtatacagtcaaaattataaaaataacataagaaaataagtcactattagtgagatctagcaggaataacacacagtagaatcagacttcagagatgggaaaaataaaaaatagaatgttcaatagttatttttaatcagtttaaatcaataaaagatggaaaataggagagaacaagaaactacgagacgtaatcaaacatattttaaaaagaacaaaatatataatgttaaaaacttaaatgatgactttaacaattgattaaatatagctgcactgagcatcagtgaattaaaagatggatctgaaaaaattatgcaatatgcagcacaaagaaacaaagtggcagaaaatatgaatagtaatgatgaggaggagacttagagtgagaaggattaatatatttctaattagaatcacaggagaaaagcggagagagatggttagggggagggaaggagtggagagagagagaaattaaagaataaatggctgagacttttctagagctaatgagagatatcaaatcacagattcaagtagccccatgaattttaagcaggataaaaaaaatctctagacatattgtactaaaaccacagaactccaaagacagagaaaaatccttaaagcagccagagcaaaacaacggagacctgcaagggaattacatacagacaaacagctgacttctcaacagcagcgaaggcattcagaaggtcctgagggaaagataatctcagcattctaagagaaagtagctgtcaacacaaaaatcaatatctggcaacgttttttgtcaagagcaaaggtgaaataaagacattttcagacagatgatgacttttcctccaacaggcctcgaataaagaggattttaaaggatgcactttcagaagaataagagtaatcccagatggaatttctgaaatgcaagaagaattagatgagcaaaaacaatgacaaatatatgggaaaatctaaacaaatattactagatgaaaaaataatggcaatattttgtggatttaaaatacacttaaaatacataataacaatagtatgtaagatgggatggggtggacagttctaaaatatcctaaggttttaacgttatgtgcaagggctgtaaatgtattaatttttactttaaaagtcatgtatgcatgttgatatctctaggattaaaaaaactgaaacagaagatgaatacataatttccaagttaataaataggaaaaatgagaatgaaaaatctttatcaagcaaaaagcagagaggacagaagggaaaaataagcatacagaaggcaggaaaaataacatgaaataaatccaaatatatcagtaattatgataagtaaaaatagctaaatattctatggataccatctaaaacatgcaagatgatgaatgtaaatggataaaaatagctagatgaagcaaatactacaaaagaaagtggatgcacctataataatattaggtaaaataaactttaatagagcaaaaaaatgtacaagagataaaaggtcactaaacaataataaaaggaatttgttcaccaagaacagataacttttaatcaatattcacccagtcacatagtctcaaaatacataaaacaaagaatgcaaataatgacaagaagaaccagagagatccaccatcagaatagaagacttaaacatatttctccataatttttaaatcaagcaggcaaaaaatcagtaaggatatagaagtttaaacaatgtaactaacatacctgatgtgatgaacatacctagaacctacatccccaaatggagaaattcatattttttcaagcacacactaaaaatttatgaatatttacttcataaaaggccataaatcaatcctcaacaaagttcaaaagatggctactatagatcacattctccacctacaatgcaattagatttaaaaatcagtaacaaagaagttacataaatcatgtgtatttaggatttaggaacactttaactcatggtccaagggaaatcacagtgggaatcagaagaaaattataattaagcaaaactcataggatgtctcttaagccttacttggagggaaatttatagctttgaaatgattatattttaaaaagctgcaaattaacaagttaagtacatatatatttaagttaaaaaagaaatggttattaatgtatcaatattttgtgaacaaaatttacaaactatttgggaaataaatataataatgtccttattctgtgtagacacctagatttagctatgcctaccatttgtttagtaagtactatgtatcagacttggtgctgagataaaacttctatataatttaggaatgtagacccagaaggggaaaaataggaagaaaataaattttaaaagctacactatgcatttgtattattaagtttgtaagaagatggctgtataagtggctggaaaaatatttacagtttcaacttactttaacagacctagagcttttaaagcactggttttgtgctttagtacaggttacaaaaatcttctttcataatttagtgatatcaactccttaagaaaagatggtatcattggggtaatatagaatactaaatagtcactgtttgcaagacacagtgccagatgctatgttctgtggggtaggaaggggagagaggacaagaaattttgaagagccacttgagtgtgataggcttttaactttaacacttagcccacctcttaaaaaatcccaaattaccccaaacaaccacctataaaatcactattaactactactttaaactattcaaagatttttatttttattgttagtaatggtgtaaaaaggtatctcttccactgctaatagcagtataaatcagtaaaattcagctggagaccacttttaaccttatgttataaagacttacgatgttatacattgtttagcccagcacttgtgcatttagaactttatcccgaagaaataattactagagtgtgcaaacatttagctgtaacagcagaggtttatgatagtgaaaacctagggacaattgaaaagtctaaaaagaggatattaaataaattatgataatactgacattaaaataatatcatagaagaatatttaatgacatgcttcataatattaagtgaaatgagcaagttacagagcagtataatctactttttctgcatataaaaaattactgtaaggacataaacccatatgttattattgctagttatctctagatgtcaaaattatggaagaaagttttctttcttgttttgtagtttttctaatctatattgtttaaattatctgtactattcatgtgattgcaaaggaaacagtaaaatgtatatattttaaaaataactctatttctagtgttttcttattatcttatgaaaaccactgtccaatttcttttgttctgcttgcatggccctttggaactggtgtggctttaaaccaaggctgtctctttgaattctaaggtctactatacagtctgtgagatgtctacagagcttgaatgttcaacaacatatgaagatgagtattgtttatatttccagttagaaatatcattctgagtttgtaaaaagatgcagatattttagcttaaaattgaatggatgcatcagagttaattagcaatgcttcaaattacagaccactgcctcttcttgtgcaactaaccatcaattagctatgctaatgagaaaagcaggaaatgattgcaggagaaaatgaaatcagtagggaaaaaagaaaaacaactgattttagtctctagtttcagccatcaattgtcaaaacttaccaggattacatataagtataaattctaacctctctttgaaagaggcagtgtattaataagaaagtaatgttaattctttagaagttttttcttttctcgattatccttcagagatgccatacctaaataataaaatgaccagaatatgagcagcaggaaacttatagacaaaaggttcgtcagtggttctagtgtaatccctaggggaacacttaaaaaaatatcagcatagaggtctttctccaaaccatttaaatcagaatctctgtggaaggtgctaattaatccataagatgcaaaatgtatttcaacttgattccagctgctgaatatttgctttactctgagttctctttttggacaggaagggactctgataaaccacctctggttctttcatccccacctccatcactccatttttaggcaggagaactttcccaatgagacagtcttacaggtgtctcctgtaggatctttaaataccttcctactggctctcttctctgttaagggcttggatgattttctcaaagagaaacttttatgagggaatgcaggattcctaagcagtatctccctacccagtgccatgataaatatttggatgcaaagaaaacaggaaataagtcattgaatggagattgcagctccccagagagctccagatgacaggctcctggaaagtgttccaagttctgtttgttctccagtcctgagaacagtaatctttgcggctgtacttttcctcttctttccctagatttcacttttacaactttaaaaaagtataatagcttgcattatatgcttactgcacaaagttttaagacaaaagaattacaaatagcaaaattgaaatcatctgtgagcctccctcttccccactccagagaaacatatcattaatgtcattaatgtatatcttccatgttttctatgtgtagaaacatgtattttattttacagaattgagtcatcatatatgtacacttttgtaacttgctttttaatcttaaccttatgttttgagttttctggatcatcaagcttcaaaatcaagatttctgtgtatgcagcaaagcccatcatagatatttactatcatttatttaaccatccctccacattagatcttgattattacttctgaaatctgccttgttttatctttttccactatttatcagaaaacaagatcagccctggtgggttcataccaattacttttcctaactggtgcttgacattgtatccactaatttcctaaagtcacagatgataattacagatactgaacccttacaccctcctatgctacatatgcttttctccaatttttgtaaccagcacttgcttaatcggtgataatactgcttttcttcctttaggctaagccacactcctcaaaaatcctgaagtttacttcaccgtcttccaaatatgtatgtatgtatggaagattcatcattttagtagctaacttacactgaatgttactgtatatactgtgacaataggtttatatgattttttaatttgacctttatgataataacacggggtaaatactactattattcccattttacaaagaaagtgaggcttcttttgagtaacttgcccaatatcacacacaactagtaagaggcaaagctgggccctgaacccagaactgttttcttctgaaccatttttttcattattattaactaaagtccgtgtttattaaaattttcttaatttttacctaatggcctttttctgttccggcatcacacccaggataaaacattacatttctttgtcatttttcattaggttcctcttggctatgacaatctcttagactttacttgttttctctaacagagtcatccctcatcagctacaacaccatagcagatataattcattgtgcattactatgtatggttctgatcctcacagcaaccctccaaaacagatgttttaatcctcattttatagataagaaaattgaggcttagggagatgagaactaatggtgcagttcacaaagctggtaaataatggaactcagatcctgacccaggactatctgaccttgagtgtcatgttcttttcactactctggtttagatgacttatacatgcatgctttttataaataaatctgaatgctaaaaccagagtcagggtgccataaagaaaagttacatctggttcaactttcttatctaatatccaagcactttctatagattatccaacgaaaatttctaaatatatagtcaaaaggtatcagtgtagtttgtacacgtttccacaaagccttgcccaattttgaacagtcctgattgttagaaagctctgtgttcctccaactgatttttatcctttggtcttaatgtggctcttaggagccaaacacaatcatctaagccttctacctaagtaccctgcaggcagacacatctcccccagactctcttttcctggcagagtacggcttagtttatattttcctcagcatcctaatgatgctactttaaatcacagtgacttgcagtatccctgtttagttgcaagtccttatagtgcattttggtacagcaatgtgtatgtcctatacaatcaggactcaataattgctgttgacttcttccttaaagggaaccacttaccaccatcaccatcccttctcgcctcccctctccacacactacatttctaaatcctcaagtccaaaggaccctaacactgacacttcttgcaaccctttaaatgaggcagctctccctagaaaaccccttgagacacaagtttggaaagtgagtcaaacgtaagagggatgtcttctccgagtctgagaagcaagttaaagggcaaaagcagtgagccgtggacgcctggagacagtttctttcttcctgaattccccaaagcgcagagacagacaggatctgccaggacagcgcgcagggcggggcggggacaggcgcgccaggagcggggcgggcttccagccgctggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatggtgagtagaacaagccacttgcacactcaggtgtagacgtggctccaagctcagcccgctgaaaggacctggagtttcccctttactgtaggaaaagttatcgacctgggttgttaatgcagtgtacctaatacagtatcattaacagacgtttggcatactggtgatacacatctatataccttgttaaaattctgggtggtgaatttccactttcccctttccaatctctctttgtgtgcgagcgcgccatatatatggtagacatacatatatattgtatatacaatgactaatatcattgtatatgttcaaggcttgtgggctgagactcagctatttgaagtcatccttccctaaatgggctcacttttacgcagtgactttgctgtacacccctcactctctcaaaatgagaataaattttatcagctttcaaaacgactcctccaccaaaaaactacttgaaaataaaatggaactacttaatatttgtttttattaataaagaaataaaatatctaaaaggtgtgttttaactctgcaaactgggattcaatacttacacctgttaagtttctccaagcttcagaaattttggggttaaattttattggaaagttcacgtttattcattgattaaaattcatgtacttaatagccttccttttccaagcactaatataaaccctagcataaagcacgtattctggaacagtgtttactgttcaaacccatgtattctagaggtaggtgttggcactttgttattggaataacaaaaaatagtgttgagggaagctttatgaattgtgagattaaaaacatatttagataaatactgtcatgtgttttttatatgttagtattatttatgtttattttctcacatttagaaaaaggttacatagaagagaaggaactcgatgctttctttctccacatgttgatgaaactgggtactgatgtaagtacttgcacactaagccttaatttatgcctcttagtaagatacgcacatccaagtcttatattgattggtacctattaattccaactcacctcctttcttccttgcatgtatgtaatttctccccctctcctagcaacatagagggatttaggcagtttttataaaaggtgcaactgtagcattagacatgctggttactgactttcagtgtaacatctgtcatccactcagagatcctaactgtagactcagttaacttggtcttgaacgtctccttggttatgtctctgctaattgatttatacctgggggtaaagtagcccactttgttcaaaaagctggaaaagatgttaagcacattaagattttgggtgtttaatatgtatgatactcctctgatagcaaaccacaaaccatttaaaatcatttatccattattcattttattagaagaggttacagatttttcagggaatgacaaaccagaaaacaaccagcatactcagagcccagatacaaatggaagccaatctatctagtgtccatctgatggtaaatatgtccttgggagatgtaaatgaactcttgaaagtctctctatcaaagcagagaaaaattttacacagaaacacatgagcggaggacagcctggggatgggctcgatctgatgaaagctccagtagggcattcatagtagaaggagacgctctagggacaattgaatttaaatgaatgatggagatagtttgtccttatcattcagctgtttatctgaagaatagaagtgcatcacattctcatgtgagagctcagtgagggaacaaggagctcttcaccactgttgagaacatggggagggtatgtggggggcaggggaagctggttcagaaacaaaagggctggcttccgccttcttcagccacacagatctcttggtccccctctacttctgtctgcctctcatattctgtctgtctctcttttttatgtctatctctgtcatttttctgctcacttctgtttcttatctctgtgtttcatggctctcatctcctactgtttcttgcctttctctctgacctctctgttgcccatctttcttgtctctgtttctcatttgtttctccatctctctgtctctgtgttttcccattctttttccagtctctctgcttctcaaagctcttttggtctttcctctccccatgtcttttatttctcctttcttctttctttcccatctctctttttgaccttcatttcttttctccacattttctccttcacccttttctttgtctcttatctccctttttctgtaccttttattgctctttgtctgcctgcactccaccccttaccctgtgcagcctgtgaagtgaaaggatcagcagacgagaaggatagagacacaagtcccttctttcctctggtcagaccacttgcgcacactcctctttatccttcattcttgtacctacacaagctacaggtagagctgaggaagcctcccccaagtgaggcttctgcttcaatctagccagccactttcacgtgctagcagcccatggtgaagcccaccagccttgcccacagggcttctacttatatctgtaaatgtaaggttcatcgtgttccagaaacccatcttatctatcatggacatgggtatttgaggaaagcaaaaagacaaagttaaaaccattcaaaatcttggaataaatgggatggccagctcctaaaaatctgtcctcagggacctggaacttctcaccttttcagagggctccttgttctagtcatttataaaagggaggagaaaaattgctgtcactgttgaagctggagtatctaatattcattcatcgagttggggtctgcactaagatgaggatgctgtgagatatcttcatctgagattttggctaaccttagaagcattgttgccattgtgagagaaaagagggatgtcatctcttgcagcttggctgtttttatcattgcccctatctcagacctggtccatggactaatgctcttacacaggggcaagcataatcctcgaggaaagaggacagcaaaggactcactggtgtcctgcgcaactgcattcagtgcaaatatctctgaggctggaacgggggttggaagttctcataatccttaacctagtgcaaatcaaatttcagtatgcctgagaattatatttttttgttaaaatgcagacccctaggtctcatcctgtaggtatttaaatacatttggggtctgccaaagatctttcattttaaaagcactcaaagtcagttagcatgtttttttacccttttttcctctaggaacagtgacttttggagaggggattctgatataattaggccaatcccactgagctgtggcaatagcctcaggcacatctcatgagcacttggctgggaagaaagcttttggagccaggatgataagtttgaactcttaactagaaatgatatcatctgccattggatgcctttcaaaacgctgaggcattactctggggagtgtgtttgcagggactttcactgggcactccatgctacctggacaaccatgattaaggaagctattcctaattttgggttttgtctctgatgagtaataagtaggccttaagcaagttcttaacaatagggcaggacttccaaaatggaaggcccttcagttgaggaacagtcaccatttgattgtgacacctgcttttgattggtaatgcccagtgagtacagaatccagcagcagggaggcctccacaatcaggcagccccttgctctggtgttcagcagtggtaagccaaccttcagaggcatgaatagctctactttcctctgatgattagcggatcacagagatctcagaagaaggtattttgaggtttctaacagcaagctgcctgctagtctatccaggagagcaaccagcctgcttgtaattacctattcctcagagcctcggaggggattgacttaatggaaccatcagctgcaattgctgctgtttctgttactccctgcaaaccttttctttccaaatgctgagattttagccagttcatggataaacatcagattctatgtgtacatacccctcacatacagactgtaccacatcctgggcctctttcaatacttcagggattatagtaccctgctgtagcctagcgtctcagataaggactgatgggaaattacaacagaggaagccccagtttcttttgctttaggtcaaagggatagtcatgagctttggggttaggggtctgagaagacagaagccaagattctgtgtcctcaaactaaaggtaatgtagaatctggccactgttactttgacttcacatttatttactttaaaatctaatttttcaccaacatgacctatgttagttaacttcctttgggaattcccagcccatcataaagaatcatttattcatccaatggatcctgtgttccagagataaagaaatgaatgttatacttgtggagttcttaatctaaaagatcaagctgaatttcaaagtgaagttcgaccctgttgagtgatttccattgtgcttttcctgtatggtacatgaaccctcaaatgtaagcacacacaaaatctttagtgctgaaactagacaggttaatcccaccacgattagtggggtatcacatgaggtaacctggttgacagaagaacctggagtctcaaagaacctgttcaccttccacagagaataaaaaaaatgtacctattgtctctgaagacccactccaaagaagactcatggtcggtggggaaaggacaactatgtgtggaggcagaaatccaatgctcattccctgtctctccatctagagctgtgtgatagcaacatgccatttaaacctcctgggtctcaattttcctatccataaaataataattattagaataatgttttggcctgcctgtttcacagtgaagacccataagataacacaagtgaaaggtgcttttagttgcaaaagcacccaacatatatgttcttatgctgacgcaatatcttcttgggtccttagttttcccagtgtttattctatgccccactttgcctcagatccaccaaggggttatcccacacaggatcattgaagcttactctcttaaacactgaaatgcttttaagattttatatatatatataatatatatattacgtgtatatatatatgtgtatgtgtgtgtgtgcatatatatatgatttccagtttatgagagcaagttttccaagctagggtagcctttggaggatgccttaagtcatactcaccaccactctttggtccttcatgagtaaaggaggctactcaaaggaagacagaagacagactgtcacctcagggacctgttagacttgctctgtcttagacaaatgatacaggcattatctctcatttcttcacttgatgctttggttccaaatcactaatgtattttttcacatttttagtctggtgtgtgttcatttagaaaggtatccttttttttttttttttttttttttttttttttttttttttttttttttttttttgagagggagtgtcgctttgttgcccaggctggagtgcagtggtgcgatcttggctcattgcaacctccgcctcacgggttcaagctattctcctgcctcagcctcccgagtagctgggactacaggcacgtgccaccacggatggctaattttttgtatttttaatggagacggggtttcaccatgttagccagcatggtctcaatctcctgccctcgtgatccacccacctgagcctcccaaagtgctgggattacaggcatgagacaccatgcccatctggtattcatttttttttttaactagacccttcactgttccccatttataatcaccatatgagtatgtttggttgatgttgacagagtcagactgtctaagtcctcttattttaatcattttgggtttctaaatacaggaccaaagccagaggtatagcagatgaccttgatatggctaggatgcacagatccatttgactgatacatcatctcaatcacaaatgctactggtttgggtttataattttaaagaatagctatacatatagatgctattttttagttcttgttcatataactttaattttttcacaaagagactcaccttcactgcaatttatttcaaataaagtttattcctcattatttattatccatttgggaactatacaaaccattaattcattaacctctttctgttgcatgcatttcatctatttatcatcatttgcagcaaaaaagcaacaagtgaaaaaaaaggaagtacaattctatctttatacttgctgacaaaagtttgtgtatgattgaacagggaagaggcaaactactgactgacatgaaacttggcagttccctatatatccagtatccacaccaatcctggaagtttagagaatcagatattagaggatccaatagcttaaatcctgtcagctcacagcatcttttctacctcactattataacccgacatcaaacatttgctatgcacccacctcctgcaatgagttggtacgatggatgacaattatcaggggctgaggtctagcataatgcccaggaacttccctagcattaaaattgtttttgctgaccaaagtgttccctggttttctaagaatatgctttcaaaccttcagggtcttataatatctaaagcttgtggttatctaactagttgccagaacccatcctgaaaaatccccaaagcaagtcatcaagctgtccttgcattttgtttgaaccatctaatttattaacgacttaatgttggaatgcaatgactccattaggtgttctctgcctcatctcaaccaacaacaaggtgcggtggaaagtgcactagaccagatatcaaatatgctggtttcaagattgttctgccagtattcagctgcatcacccttctggcctgttttctccatcagtaaaatgaaagggtagtgtctcagattcttagaaagggtgccaaacatcctctgattttttttcttctttattcttttgcttctaaatcacaaagactaatctgaaggaatcatacgttttgatttatagttgcagcaatggataaaattatcatgaatttgagtattagtcttcatatgttaagatctggaaggtagagagtttgtactacttttctactagattttctactcactggaaaacatttgccatatgctgtcttccctgggttttatgcctgagagcaacatgttgtgccaggctaaagtgttttaggacgttttgttctaggaaggactaaaacagagcatgggttgttctggcaagttctttgccatatgcaagaggtcaactgaaaagatgacagcctgatgggaagaggtgaggactgacagcccctccgagtcaagactacaaaaaaaacagaaacattttctcagccagtgatgggaaaatgataaaggagaatttccatgtaagaagctggagcacaaaagaaaaaaacaaggtccccaaagaggaagaagctagcaggccagcaaggaagccaggggctaaaggttatagtacatttttttctgcctcccagggccgttgtgaagatccagggagataatatttgttaaagagcatggcttagtgcccatcctctggctggcagtccaaaaatgtttattcacctgctcttctttcctattcttagcaactggatgtggcagctgttaattccccaccacaattctctttccaccgtctcctcttttctttgtaacccattagggagaggtctcagtggaaaggaaggctggacaaagatgccttccaccagcctgtgatggagggcaaagaccaggtctcttttgctgactataatatcaccaggggccagaattgtgtttggcacatggtaggtgcttgacagaaagcagtcttttctgggttttatacctgaaagcaacatgttgtggtgggctaaagtgttttaggacatcttgcacctgggttgttctggcaagttcttccttatctcaggatgttgcattaccagcacatgctggggttattcttgagaaatacaagtgagaaaggcagaagaactgagttagcccaaggccacccagagaactgtcctgtacacatgtgcatggatgatgcatccagagagtgtgctgaaggctgagtcacctccacccccaacaccaacagggaggataatgagtcaacaggattacctcttctcagcccttctaacttacagctggagggcttgggacaagagacagcatgatagtattagggagaatgagtttagcataaatttcagcaagtctagaatcttacaattgggcactgtttgggattatctatgcttctcaacccttgcatcagaattcattctttattgttggttacatatgtcacttttactgtagtaaccataaaatccaccaaagaagacaattaaggttctacatagaagggagttgtaacatctttggttaactcggcaattaccttattactttggtctcctctttaattatttctcccttctcattatgtttttttcctcagagaatacaaaagaagattaaaaatgagttacagacacctgggggcccagaagaactggacttttcagttaaaaaatgtaaaatctctgagttattgggaagaaaatctgtaattacaatacagtcttttgtcacaaccaaatacaacactgttcaaatttgttctttcagcaccctagtctctaagcttcttttcatcaatattttagtaactcattaactgtaaattgtacctagtcaagattctgattagtgcttggttgctcaagaaatctccagcattgctctctcttctacaaaagggtaaaatcactttaaatggtcaaggaacctgctttccatgtttgaaaaacataattttcacgctgtatattttgaatatttgccatcctaactatatctttgagattccagtggctttaatgtggctctgtttggtcaattgcaggacacggtcatgaaagcaaatttgcacaaggtgaaacagcagtttatgactacccaagatgcctctaaagatggtcgcattcggatgaaagaggtaactttactgacagtatttttcatggctctactcttcttgactgtttttttctttactttatcgtcttgggctgtaatattctttgaaagacaatggaaactttacatttgatcaggaaattagagatttctgaaaggcagttggcctagatagcattttaaaagtaatcacctctcctttttcatctacttagtaacaaagagtgtgcaattcttttatcattttatttaggtcaatcaatatttgtacctgttttataatttgggaattgaaatgatagaggcctttcaattacttgatctactatttgtctctttatacagtgtcctgttcaaattgaacattgatataaggaaaaacttactgataataaataaggttaaacttcagcatcagctcccagtgcaggtgggaaagatctatccctaagattattaaaagcacgacagacaataggtgtctttacttcaactcaacccacttttatggagcacatactaaagcatgtaactatactacatgtgtagggctgtggggatggtctacaacttacctgatcatttctccttccagttacaaaaatgtttacagtttagaaaggacttccacatatattttgttattgtattcccatagtagttaagatgatgataggcatgaaacattatccctattttgctgataaggacttgagttactttcctagaataacatgaccaaataagtggtaatggttttaatggaaccctgcttatagatatgaatctatacaggttcatactatgtagctataaatctgtatgtgaaaatgagtcaatctgaaactaagatattttttcatagtcaaaattgcctgttagacatattacctaacactgggagagctagtctcttgatgctgtgacactgccatatttgagcagtcaatattattgaagaaaataataggataatttcttcaggaagttatgttaatagggcaggataatgtccctttataaaaagtgggcgtgttcaccaggagactgccttttcagaaaactaataaactaaactctagatttatgagtgtagctgtttccaaacttttaatcaaaggcaaaattgtatatgtaaccaaaaattctcattatactggatgtaaaagtatcaatgtatgtatcaacagaacagtaaatgcaaacagcaagttaggtgcactaaacaaaatattcataactacatgttcactgttgtaattttccagaacctggaacagagcatagcacatagtagtgctcagtatttcttgacctaattaacgaatgagaaaaacatagcaaataactgaaaactatgtcattatcttactaacaacagatagacattcccaagtaattggccaaccattttgtcttgtaatcctgcacgtgagtgtcattgaggttgttgtttgtacaaaaactgatggtgcaagactgcatcgttcccaaggcgccttaaaacgcaatgagtctgtgagtctaaggagcagcaaggccttttgtttcccctacattcccttgctgtaccattgaccatttcacttactccaattacaggtagtcgtgacataaaaatcagcccactttgactcatgttggattttctagcaaaaaacaagatgggaaaaaggccacccttagtctcaaagggcagttcccagttccagttgaccctgtgtaggttgatgggaaaagcatgaagtcaatatggtggaatatgaaaccttaggcaagttacttaatttctctgagctcaattttatcatctttaccaacatggcagttatcatttgttgactaattgatatgtatgaggtatgttcctaaacaatttataaatactggctcatcttacttttagtcttcccatcaggaccaggatatcaatattattatctccattttccaaatgaggaaactgaggcacagatatattaactaaattacctaagatcaaatacttagtaagtaatggagaagaaatttaatttcactctaaagcctataacacattgaactgcactgcctcccattgataaaaaggggatatttatactcatcctgaaaaactggtgtgaggacttaatgagatgataaatcaaaagcaccttgctggtacctgccatgtagcaggcactcaacatctgatagttattgttaacatggtgtgtccttgagctgacccatatccaattagaaaatatgaatgagaatgtgagctaattacacctaaatcccttctggagcatttgctgtggactcactctgtggtattgtacaagacactgagcaaactactcagttatagaagaaatgacaattgtttatgggaacagctcagaaagaagacaacatacactacaatactctaggtttggcaatgaacacagccaaacctgaaaaaaagtattataactacataggggaataaggtattattataactttgttcaagggagtgcatgaagtaaatcagtcaaactggtgctcatgtaaaaaagctgattggttgaattcatcatacttgagtcaactgttgtagtatcttatagacactaataatgtaaaagaatataaaccatagctaacactcaagtatcaagccaggcagcagtcattcctgcttttgcactgaaatattgtatgtatacaacatcttaccagcaaaccacagtgattaaaagtgtgggcttgagatcgccaagctgaaatattgacttcatcacacactaattacaaaactttggcaagttccttatctctgtatagaccagtttcctcaactagaaaataacagtaatggtatgtgtgtaccctatagattgtcattaggattaaatgaattagcatacacaagcatttagaataatgcatggcaaacataagcattatttgctatttttattttctgttattatggaattaaattaatttagtattggaagttcttagaatagtgcctggaacatatcaagcacttaacaaatttattgttgatattaatgttatagtcatcattattttagattttaagctcattgaaggcagatatccatagtgatttatacttagtaggagtgtgttactttctgaaagaatcaatgaatcaaagaatgtcaatcaagagcacagaactgcaaaccgagctgttcatcctggaagatctgagcccttctgccctggaatatgcaccaccatgccttttaccagggagcactcttgaaatggacactggccagtgtccctgactgttattctttctgttccttcagcttgctggtatgttcttatctgaggatgaaaactttcttctgctctttcgccgggaaaacccactggacagcagcgtggagtttatgcaggtgagtgcttggttgtgtctctgtgaagaaagaggactgagacaaggctacgatcttagccacctgctgtggctgccaccactcctgcccagtgctcaagggagagctgagcacagaggataagaccaagcaaaaaatgccttagtgatgaggactttggtcccaaaccccagtgttcgctcagtattgtcctggggtgctcctgagctgacaggctcctttaatttgggctggaggaaactttagacaagaggccaggcaggtacactgaagaatggagagggaggggaggtgggggactatggaaattggagagcatgtgccccatctgaagccaatatccctatgtagcttcagccttttgagaatgctatctaggaatctagactctagaaaatagcagcaactaattttagttttgaaggcatgatgatacagtcaaaacaattcattagagtgctggtccagctagtgggccttctgtttataaccatgggagagtaaaagttaaaggcggtatcaatggcctctcttaccgctttccctctgggctaccccctcgctcagcctctcagtgttactgctctgttggtgaaaaacaaccagggaagggcagataagggtttccccaaggccagagcagcagattcaagacagccactgtatccgggaccccacactggaaatagttaccatgtccccatttaggagataaaaagttttgcataggcaattcacagaagaaattctgaatggaccatgaatttatgccagtaactcaggaaatgcacattaagaaaatgatttttttttaagcaaaatggcaaagattttaagaaaatccacaaaaatatgcaatactttcaaggaagcccagagattgtcactgacgttctgttggtaggcatacattgtagaataattttatggaaagtaattttggaaaaattcagtcaggatcctttaaaatttcattatccacagttatttatttatttatttatttatttaaaaaactttgtcctggctgggtgtggtggctcacgcctataattccagcactctgggagtctgaggtgggcgagtcacctgaggtcaggagttcaaaggcagcctggccaacactgtgaaaccccatctctactaaaaaaaaaaaaaaaaaaaaatacaaaaactagccgggcatggtggtgggcacctgtaatcccagctactcgggaggcgtagggtggagaatcacttgaacccaggaggcggagttgtagtgagcatagatcgcaccattgcactccagcctcagtgacaagagggaaactcggtctcaaaaaaaaacaaaaattctactttttcaggcatctattttatggttaaaatcagatgtagacaaaagttttctgtacaatgatgttcatataatgttgcatcgtcacttatagttcaaactgaaaataacataaatgtctaacaataatggaaaagttagttatgatatattcatataattcattcattctacaaattcttaagagcaccctaatatgcaaggcactgttctaggtgctgcagattcattagagaaaaactccggtattgaacattattaatcactgaagatcaagttttcaaaaaatatttaatgacatgaaggaaatgctatacaatgttaagaaacaaaattgtatatggaatttgatcttaactttgtttaaaagttgtttaccctaaagcctgaataaataaaatataggtaagaatacacaaaaaatattggttgtttgtaagtggtaggatttcaggtgattttattctttgtacttttgtattttccaattctgtataaagtcataattatttaaaatttattttaaatgacattttcaaaacgattctaattgtgtttaaaaacactcagataacatttttaataaaaataacaaatagactgcccaagtgtatagacaatatgacccccaattctgttttttagtgtatgttgtagaaacatgatagaaatgaaacacacagaaacaataagtaattatctcaggataggagtttctggagattatacattttttctttttgtatttcattaattttgtacagtgaacatgatatcagaaaaaaaatcatgaatatagaaaaatagtattaaaatgttaggcctagtgtagtcttgaaagaccttgagaagtgggaaaatcacatggccctatggaggcttcttatcttatcttttttttaaattccacttttcctgcctttgtagtttgtcaattttatctgtaaagaagagctttccctttctgtacccaacttttaaaactatcattgtgaattcttgaatttgttttttaaaattaactgtcttatatcccattacagtctacatatttgaagaaattctaagttaatgtctttacttttcccctgaaccacagggtcttaacacactataactcttacccaccagctcatgtgccattattgtccagaatattagttctatcttgttttctttaaccccacaaattttatgcagtcaagatttgtttcaatttgcccatgtgtcaccacatgtcatattgctaccattgtctttgttcgccattcctttttgtatgtcttagatttccttcatcctgttccttcttcttcctagagtatatcctttaccgggagtctgctggtaataaactctgcttctgtttgtctggaaatgtctttactttgtctttattctttaaagataggcttattgaatagtcacataaaaatctttggctctccaatggctcagctgtagtaaaactacacaataatttaaatggaaattgattggagaatggcacttaaaaagcatgcaaaaaatttttaaaattatttgaaattctcatagttttggcatattcatacgataaaagatataaatcacatgtaactcactgattttgtaactggactaaattcagacataaatgacaggttctggaaggagtgatgtttctgaattgttgttactaaatatcagcatcagtgtcaacacagcatcagtatcaacacctcctactattcctgcagagtctgagctcaggacgctgattgtggttaataattaaggtccttgcaattggtaacacagaacacagtcatcccatttaggatctaagaaaaatctgtcagtgaaaaaaaaaaaaaacttactgtaacctttcattttgtacaagagttaatgagcttgccaattgatgtgaggcttgtccatggaataatcagaggtggggagagtaagagcatttattaaataaaacagttcagtgctttcttcaaagagtgtcagctgttctgtgttctggttcgtaactgcttcttcagctggatgaatgctggcctcacactaataagaggagtagcttataactgggaattagagttattttatcccctccatcagagacaagaccacacaggcaagatttcttagaggacttttctgcagtgtaattttttaaagttcatctttcattcagattttagttttgaagttttagtttaaagcaggcacctcaatctaattttccacctgtgtgggtcccatgatttattccctgtctaccacatgtgcagttttctcataaaactgcaggctttgttgccagggacaggcagacatacttgggacaggctttggtttcagtcctacattaccactctgagtttatgctttcccatcatgtcgggtctcttagaagtcctttcactttcttgcgatctatgctatgtaattaaaagttattggccgggcgcagtggctcacgcctgtaatcccagcactttgggaggccgaggcgggcggatcacaaggtcagcagatcgagaccatcctggctaacacggtgaaaccccatctctactaaaaataccaaaaattagccaggcgtggtggtgggtgcctgtagtcccagctattagggaggctgaggcaggagaatggcgtgaacccgggaggcggagcttgcagtgagccgagatcgcgccactgcagtccagcctgggcgacagagcgagactccgtctcaaaaaaaaaaaaaaaatctgttttcataggatgctgcatttttaggtatttagtactgaggaggcttcttagtttgtcatattgccccaaattgaagttcatccctttttatatttccattctgagctttccaaaaggacacttttgatgaaagcccactcaatgggctttcactgaaaccattgtggccctccttaagtggctccaagtgaatgcagtgatccatttctggtggattgtgcccaaaattgctctcaccaaagaaagcctaaagtttccatcaaaagtggaatttccattcagttaagtactgttttcagatgctgaactgtagtagataccacataattattccaagttatctgaggataaattaattagtgacttttgtgtatttcagatttggcgcaaatatgacgctgacagcagtggctttatatcagctgctgagctccgcgtgagtgtcactgggtgaagggtgggtttgtttatcattgggaatttgatatgtgtgtatcatgagtttgatttctgtgggcccaagaaagatgtatttgaatatgtgactcaaaaaatacatacatatgtacatatatgtatatattttcatttttaaaaggtttagaaagtgcaagtcacattgctctctctggaaaagaagcataattgagcatttatgataactttttcacgctggagctattccctgggtcccgtgagctccctataaacagtgacagccctccattcttggatttattgcttgctaaaagcattttatttcctcctggaaacaagcaactcacaattcttgaaataaggccttttaagacctttgcagtttatttgctcactatataaagtatgattcttctcttggcgccacagaacttcctccgagacctctttcttcaccacaaaaaggccatttctgaggctaaactggaagaatacactggcaccatggtaagtaatgagtaatgtaatctccatgagggcagctcccccactccctccccagaccccagaaacagtgtctgctagagagttcgtccttgagaaattgaagactaaatgaatgcaagaggaaacctcaactctgaaaaatactggctaaaactgaactgttttagcctctctcttgtgaccaggttgcatctatttgagagagaaagctgttcaccagtctgtggggaaacctgaaaagttcagtcaacattaggtttctaagcatcaggccaataacctcaatgttaattgaagtcacatggaaacaagtaaacatggacttagacaatcaggaccaaacagatggaagctgcctctcaccacagtggatgattctcctcatttagcatgttgatttagtgcagttggagagtcagatagatgaaggatgcatgtcctacctctgccacttactagctatgatgtaagaaaactgtcaagcctctcaactttatttacttctcctataaaatggggacgaataacacctaattcctgtgagggaaaatgtgttaatgcatatgaagcacttgcatactgtccagaatataatgagttagctcttattgcagtagttgtcattatttcctgttcccctcatgtcatccttgttccaagtgaccttgagactatttttgtgtcaagctccatggagagtagtaaagtagggagctgcctttggcgaactcatcctcatgttctgtttcaacacctaactcgatgcatttctcccagtacttatcaatgatttgtattgaactgcatctggctcctctgtcttttctcctcccctattcctttctcatccctacgtgagtgcttcattcctatcaaaatcttcaggtttcttaattagtaagcaaggaaatttgctgacaaagccttaattacttgtaggattgttatatttattatataaagagttattgagcagaatcacctcattgagccttatggtgaagtcagggatacatattactgagaagagtttgttaaaatgtgtaccaccaggttgacatatttaggcttttaattggtgtttccaaatactatattatgtctaacaacttctctacagtgttgctattgttcacgcaattttatgtatctgatgactaaggcttagaaagggtaagtgactaagtcaccaccaggttgcgttcttaagctcattttaaagatcagataactaagaaaaagcgttccatagctaaaagcatctgttaagctggaagctaagctcccctggttttcagccctggagacttctctgctttccctctgtactctgctctgaatgtgcccccagtcaagtgagtctccgctgggaagaaggcaagtgctcttgaccctggtaacttgtaattggcctagacaggagaaaacaaatgccaaggagagaatcaaatctcaggacaggatctcaattaaggaaattattcagcttcttacggtgttgatttgttttaatagcatgcaaaatggtgttggaaatcctgagtaaatatgtgctcagcaccaaaggtcgaagtgggaaatcccccagcagtgggaagcagtttcccagctacaggagggtctctaggttccttttgacctaagctccagtgaagccctctaatagaatgagtactatgaaaaagaaaattagacagaaactgcctggggtacagaacaataaggaggtggtttttctagttcagcatatttttaacattgatttaacagaatgttagcactggctgttgttatctcgattttattgacttataaaacatgacctacttaatgaatatattttcatgtagaatctccagcatgttgccagtatttgtttgactatctttgactctgaggggcttgcccccacctccagctaaccatactaaaccactaaggttttacttcttaatatagctcagcttcccccctcaccaacttttttcacctggttcttgctcatccttcgatattcagttagatatcaacttgccctaaaaaaaatcttctgtagccttccctccacggtgagcccagtaccccttctctgtgcctgtgtagtgcctagtgcatatcattatcttagcctcttaataatttaatttattccgcaaatattcattacatatctactatgccccaagcattattctagtcaccagggattcaacagtgagcaaaatagacaaaggggagactgacaacaaataataaatgtaattaataatgcattatattgcataacagagggtgatgagtgttatggaaaaaattaaaaagtggagttgggccaggaatggcagtactagcaggagcatttggggtaggggactgggaagaaggggtacttttcaataagatggtcagggtggcccctctgagaaggtgagatgtgaggagggactgagggtacaggaggcacaaggcccctagtgcaagagcgcacttgggatttttaagaacagggagaaaccagcatggctggagcagagcaagaaaggatgagactaaacagcagccagaccatcacaggatttttaggccatcgtgaggacttggggttttagtgagatggaaaacggctagagggctatgatgcagaggatgtcaagatttgccccctgggttgagaagagtcctcaatgggcaagtatggaatcaggaagatctgctgagaggccattgttgccatccaggtgatggaagatggcaacttggactcaggtgaggtggcagaagaggtgagaactaaatatattttgaagatagacttgagaagatttcctgatgaatcaggtgggagtcaaggatgagactgatgttatctgtttatgggtcttgtaccccactagcctgtgactcctcaagggtgaggagagcgtctcaccttcttgtctcagccttcacatgggacctgacaagtagtagcctacttaatgcaagttaaactgaaatttcagttgttacctaatagccagctatgatgaaaccatgacaaaataaggaacatttgtctttgggaccctgctatctcccctgtcagtgtttcttatgaccctgtgcccctattatggctcttgctccctcttggggtgcttggagggttgcatattgcacatttcagcattttgtacagacctaatcttccccaagcagagctttatgctctgaaattctccttttcccctcccccttaaaccagaccctccagggcagaatcagaaagggtgcagtatgtggctggaaaaagatgatgcacatcacacatcaggccagcagccctagttgcccagagttcttcccttcacagccttcaggcttgaattaaagaagcttcaggctggcatcatcttacaatgggatgtcctgagctcaagaaatttcgatagtatgcaatatttttagcctagattcgtaagtctagagtcctgggaagtagctgagggaaatcagagtgatctcacccaatgtttaagtatctaggttgagaactgtccattggccaagatggtcctgttattctatgtctgtttaattgcccacacctcatagctcttctgctcatgtgtgctgcagttaagtactcattttggttctaaattgtcccatggagacaggtccataatcaagcaaactccagatggcccctgtgttaggccattcttgtgttactataaagaaatacctgtgactgggtttataatttataaaagaaggtttcattggctcatggttctgcaggctgtacaagcatggtgctggcatctgctttgcttctgaggaggtctcagggagcttttacttatggtagacagtgaagcaggagcaagcacatcacatggcaaaagcaggaacaagagagagagagagccgaggaggatgccacacacttttaaacaaccagatgttgggagaaatcattcactatagcaaggacagcaccaaggggatggtgctaaaccattcatcagaaatctgcccccatgattcatcacctcccatcaggccccacctccaacactgggcattacatttcaacatgagatttagaggagacaacatccaagctatatcagcttctcattggctttttatgcactgaggtgagagccaagtgtggagaaagctggtgaaagagtttccacccaaagatttgagtttgatcagaagacaaaatgagttcaatgaaattttgaccaatctatttcatttttcttccctaagttatagaggtgacttatacttttcaacaaacagattttggaacttgacagttggttttttaaaagactttttacatttccctagaaatttttgggtgtactaacttctaggaacttaactttttagaaaatgacttctgcatcctgagctctcatacaccaagcgtgaaatcacgttattgctgctttaatggatttttattgagcaatggacatagtcatggcaatactgtattaaagattttgttctcaggtttagcatcaaatgctttacttaagagatgtaacttattaaatgaattcaaactgatctgaataaggattggcacatttaaaaactggctgaagcatgactaatgagtgagttaaggcagaatgaccaaacagaagagaaaagctgaggtctgcacaccttgccttatcctgattcctaattaatgttctggacaagaaaggagacagcctattattaaaatcaaattatgatactgaatttagaggtgctgccaacaccaggcaggaggaaagatttaactgtctggatagaatatttttagataatatttacttttgttaaatttaagctaataattctggctgatgttaaatcacatacctagagcaggaaacttgaacttttataaaacaacaaatttaaatctgagactatggtgaggtggtaaattaaagaaaaataaaaagaaagagaaataagttttcctgtattaggctgacttgtcccagaggcagcaacaggcacagtccagacccaggaaaagtcttgataatattatctaacgttctctggagactttcccagcactccctcaacaaagggagaagaaaaacaaattttcctttattttatgaaatgagtttatagatccctgttctctataactagtgacttcaagaattctgttttatctaagaagtacaacaaaggtcataagaagcctgagtaggcctgaactacagctgcctgggcaccatagtgaaggttaggagataagcccgtgcccaggcaaacctagataatggacacctgggttgcttggcaacggttatgtgcaatcctaagtttgttctgcctctgtatccctgctttcacgccactgtaagcttgcttcaagctagcccactcccttttgtaaagtgtatataaaagtcaagtgctgtctttattccaagccctgtcttttggacgtgagtcggctggcctgagtgcactcaagattctcctgtttcaacccgaggtcactctcgtcctcctaaatcctgcaacaatggcagacaaagaggatgatatgagtttaagcttgtccccatccatgatcctggtcttggctctcatattttatgcctggatcaaagcagctcatatctgcttccttctctgggtctaggtattcataactgtgatccaggccaatctgatgctcgtctgggctcagtcctcatatcccttctcttctatgtccactctcactcttggtgatctcaactagtctcacggttttgaagaccaactaaaggctgaccactcttgatttatatgtctgattcagaccacttctctaaacctcttggatacacttagttgtgtatctccacttgaattgcatgcctaatatacaccttcaacatgtctcaaattgaaattctgacctttccccaaagatctgctccactactgggtcttcctcaagctttcaagttgctcaaggcatgacacttgaaaccatctttgatgcctctttctctatcactccacatctaactggcaaatcttattgaacacatttaaattacattctaaatctgaccgtttctcaccctgttccaaggcacaattatttctcaactgaattgcaagatgcttcccagcagatccccctatttccattcctgtctcttaccatctctatgaaacacagcagccagagtgatcctgttatactgagtcggattatataatttttcatattgaaaacctccaatggctctgtctctgagaaaaagccaaagttctcacaccaactgctcacacaccaagtcatcacctttcccaccttatctccttttatctcctccccagtcctagtcttgccacactattacctgacatacttttggttactctgacatgcatgtatgtgctgccacaggttctttgcacttgccatatccctgccaatctatttttaaccctggtatgcatttgatttacttccatctctttcaggtctttatgaaaaagtcaccttttacttgaggctttccatttccatcctatttaaaattgtacctcccaatttgctattctatatgctacttaatttttcctccagagcatttaacataggtaacatgtatatttcatgttacgtatgtaaaacagtcagtattttacttatctgtcttattttccatcccctcttccatcccctctttccaaatcagctccatgagagcatgaatctttgtttgttcagtaaatagaacagtgcctgccacatagtaggcactctatacatatttgttaaatgaatgaacgcacgaataaatgaatgaatgatgccagtcacctgtgcatggatctacaaaagcttaaactcctatttatggctttcaaactcttgcgtcatctggtcccattctctctccctgtctatcttctctcctccactcccagaacacctcttgtcctccctggtcactctctatggctaaactattgctagcgtgtgaatttctatctcggtgcctttgttcttacatttgctagtctacaatgtcttcctctcttctctctacctcatgtccaaatcctatccctctttcagaacttacctgaattcttatctccttcctcagtctcttccaatatcctgtcacattgctctgtctctttttctcagggttaaagagataatgctgaatcttatttgtttacctataattcagatatttgtttctggctcttcaattacaattgtatgccctaaaatcatgtaccaccttaataattgtttgggatatctcatagtgtgcagaatgttattagacacagagtaattacctgacaaataattgtcaattgataatatgggaggggggttctaaatcttttttggaatagcatatggcaataatttccaggcaggaatgaggatctcctttaaagtttttttaaaaaaataactgctaaagaatgatttccaataatttattaaataaaaaaggaagttgcaagatagtctattgcatatagtcctatttgtcaaaaaattagatagttgtgatatatgtgtgtgtacatatatacatatgcttgtatgtttaaaaagtttctggaaggatacataagactctgtgaatggtagttaccactagaacaggcaagggagggactcacactcttgactctgctgaattatttgcatgtttttcaccttgggcaggcattatactaaaattcttcactaagaattgttttaaaaagtcacagacttcctctcccaccacatgacagtagttgtacttcgaatctattgtttaagaaaatatctattgacaggaagttacccagtaatgattttaagtgattttgcattttacaatcactattgcacctacaaagatttgaaaaactaaaatattattcaatctaaggagaattctgaaaaactccaaagtccctgaggagtctcttgccagagaatgggaactaccacacttagaattttaaggcatttgttaataagacattgtgttccatttctgggagcctttatagcacctttcaggtagttaattctcaaaaatgtgtggatggagtatggagtatgagtgcgagtcttggaaaagcagtggtagaggtgggaagagtgatgaagggctcttcaccacctttcagcaattgcccttcacaatggaaggcatgccccctaccaccgccatcttcaactgccacagccctcctgaagtgaattagtgtaaagagggaggaaaaattcaggcctatatttattttcttttttttaaattcaataaataattattgaatgtctatatgtactagatatgtgccaagtacttgggggcacatcacaaaacaaaacaaagatccctgccctcatggagtttgcagtctagcatttattaccaatttatctgcagcctgtctgtgatcctgtgcaagtcaccacacctctctgtgcttctgacctcagctgcccaatggggaaataagcaggactggctcagatatgggtatgcctggtgttctgtagatgccaacaggacacccaacctcaacccaccacccaggaagtaggtaggctggaagtaaattggaaaagggcagagggatttgaaccaggtcatccggagtgctgtggcagtggtgggcagggcccaggctggctacatgcactgttgctgctattgtgtctcagtggttgccttgctcactaggtccttggccttctccgcagctgtcagtgctgtcttctttgccttccccttgtcttccttggctgtcccagcaggtgttttggaaggtgcatcatctggcagcttggccaagatatattgaaaactcttcacagttacaatcatgttgtttttgaaaagagcatgaccaagttcctggacagttctggagatactagataagctagagaacacccaggcttccctgaggatttcggactagtgcagttctcagagttcacacagtaaatacatcgtccctccaccaccatcagctgggcatggttgatgctacaggtgaaggtggtcacttctgattgtgtgggtgcccagtagagtcctccaggatggacactgggtgagcatcattggcaagaaatagccactcagcccagcaggacatcccactggtcttggtcaggagtcactgggacaggagcttctgggcaggggtcacctcctcatattctgtgtttttggtcagagcatgtttgctatagggatttgagtaccaatgtcacaaggcagtgaacatttggtttcagaaattctggagcctgttctggcctaggaatacttcatcatcattccagccagggtaaatgagcacccttgcagcttcagggcacggagccccgtgggcaggtgtgtgtgtgtgcaggggattgaaggggagctgggttgtgggctgagggctggcaggggcacttgctcatggagctcaggctgtgaccaacctgccaccactgcctggagcagttgtcaggactaggcttatatctcttggtttatagtcaagggtagggaaaatagatagaaatgaactatataagcatgaatccagtgaagtgaaaactggcagtcttagagttgactcaactatcatgaagtttatatttctttaggggaaattcaggccactgaattggagggaaatccacgtagagtcttttcttgctttcccagggaaaaagaggcaattagaaaaggtaaatatcacatctctggcatagtctatggcaccagatgttttacttcataaccaaacatgaagcaaaccaaattcatgatgagatatccagactttatagagctaagagcctggttttatggaaagagctctggtgacagatatacttagattaaaatcttgcttcttaaacaacctacttcaatctttctaaatatcagtttccttatttattacaaacgcagattttttttacattataaggatgttgtgataattaaatgtaataacataaaaactattgagccctcataaatggtctttattatagtttaaaaattaagaagccattatgtctcaaacaaatatgccaagcattcaaaattcactaaaggttatacttgcaaagaagcataatgtcttaatgtcacacaagatctgatttctagtctggtgctacaggcatgctgcaagcttccctcattattaatatttgaacttagagctacagaggccccaggaaagtagaagagcagacacagccgaatatgtgtgccattcatccctgctggtatacactcagagatggaaaaattaggcaaatgatttttttcctgattcttattcttacgtgagccatagccaattttctgataggtagaagcataatttaccacactggtgtttagttcaacccaggccaatttcgagcacaggattgttttctcttggagtaagtttgcacagcaatggagttaggcccacgtctttcaaggtgagttgttacttgcttagagctcaagctgacctagctttctattaagatagaacctctcataatgaaggtgtcacagaaaataactcatggctcatcttctggcaaagtttatccccatcagactttttactggatactgtatagtgtttatgtttaagggacgtaattggacatgtaacatgtccaaatgtataaaaatgtaacctgtgttttaattctgtaatacacatttttggtgccaaagtggtgagaataggttttcaaattcatttgaaatattaaaaataaactggatttggagacagaggaaggatgggggactaatgcattttttaaagcaaaaatctgttggatgtattttcagattatctcgctccctctttttccctgtgcagcctccttatatggatatgcttagagatattctgtagcattaaaatgttgtaaagtcacaaaattcactcacatttcaactcagatctgcaaagaaatctctctcttctattttgcccaaaccaatctggtctttctaatttgtggttagtgcagaaacttttaacttttagtcctatcttgtttaaagtttagtctcatctaataatgtaaacaacttctttggacaatgctaagtctctctatgaaaggaaagactcagtgtcaacaccttttgccttcacggaaacatgaggtttctcctataccctatgagagtaccctatgatatgagccctccaagccctccttggtggttgatatgctaaatgagggctagaataaaatagtttcagaaaaccttgactcaaaccaagtacccatatttcaagcttgtaatctttataaaaatcctgttttgcctgtcagagactgtggtagtcgttgctgctatcctccaaataattagttttcctcttaagcacatggcaggattgtattattctgtccctttgaaggtagctgtggccagggatctgctttggacaataaaattttaatcagtaaattatttattattctttctttctgccatggcaatcaggaatgtgccagatggtcactactttgtcactccatgtcgccagagtatagacaacatgaagtagagctgccagctaaccctgtgaaaaataaacctgtgttgtgttaagccactgagatttaggagatttggttactacgactcatcctaacagagaggctgacatgcaattccttctgtgacaaatactaattttcccccaggcaagtgggctcctcagccaatttaggcaaatatgtaatcagaagagcaaaatagaaaagtgctttaataacgttcagaattagttcctgttacaagtacaaccattttcccttctgcatttcagatgaagatttttgacagaaataaagatggtcggttggatctaaatgacttagcaaggtgagttacatggaaatgatatcatacattcagaaataccttactaggggtctgatgacatcatatatttccttttgagactggagatcaagcctcacctggagtctaaaagaataggcacatcttaccaataagctgagtgattctaaatcttttagggtaacagatccctttgtgaagataatgaaaattcttctctccaaaacgcacaacacacaacattttcacaaatgttatggatgggtcatgggaagaccctacccttaaaggcaagacatttatagtcccacattgtgacttcatgacaaaaatgtcccaaatcccatttactggctctgggaacgtcgagcagttatttcaggacacaggactactcagccgactccaggtgcactctgtgttcttgaagtgttggtgtatcctcagggaggcaccaagtgtctgaaggctagaagtggaggaggacaggataaaagcagaagtggctcagtgtccatgaaaatgttgtctgtgagtctggtgttgtgacacgtgattggtgtgtcagcatgttttgtcaagtctggctgatcccaaacagcatggagttgtctacaaaaaagagaaagacattctgagcaaatagtcagagttgaaattattggatctggaatacacagatatacctgttattggggagcatccataataccagctgcttcagggcagggctcaatggtaattgtaagcagggcagcagttacaggctgcagcgcagcagcaggtatagctgagagagaggaattccaaggactggaggcaagtttttaatgatgaggaggtaactcgacaaagtcacaagaagatgttggtttcgtctcttagtggacattaacctgagttcagaatcaccaaatcccacaccagctatctcctttcttggcagctacctcagccaggttttgatatctgtgaaaggggactcactgggaagaatatctcctcagtaacagccagaatattgaccccagtacactaaatggccttctatctgtgcctcataggaattgtgaggcagcctgtgtgtcctccttggctactttttttaggaccttcgttctaactttgtccacattgatatagaagagccactgagggaccagccaaagagggacaaaagtgtttctccatcaggcctgcggcagaaggcatctcgcctctgctccctggatcccacctggttctcttggtcaatggaggcagggttcctctcaagtagaggtcagagagctatgtgaaagagccaatcccaaagccaccaaaggattcattcaatagatgacaatctagatgaaaacaaaagcttgcaatctcatggttcccttcaccaaaagcatctatccacctgtgccctgactcagttgtgcacgtctcagaggtagtgagagttgaggagccctgtgtgccctgggaggctggggtaataaagggctcagagcagctgctctctgccctcttagtccatacacaatatgacctacctatgtatacaatgctaaaataactaacatcatgcacagactgtaacatataaaggagaaataaaaggaaagcagttaatgataaaataatgcacatttcagtgtataagtgcttgcatacaatcatagtgaagatatagtgaagtggtcagatgctttcacctgggtagaattatcataaatggggcagctcagatgccgactgatacaattgtgacattttggtaactcaggtgctgttgatatgattttatgaaataataagtcttgacagagttccaaatgagacaaagtatgttaatctcttaacacaattcatataccatgtggaaaatttatgtaagtagtaaattatgcaaaccttgagttttatgcaaataagaattcagttccaagcacaaataattaaaagcagggtttttacagtcacgattgccccctggacatttgaaattcaagtgagacatggggcaattcttcattctgcagaaatttccatgcaatgccagaaacctaatatccctagccctatgtacaaaatgctagttgtgccccctttatcactgtgataactaatagggccttctgcatgagtctaaacactctgtagaggcgggtttgctatggtcctgctggtagggcagggactatgctctaatcccttgaataacttctcacttggtggagtgttgtgtacttggggggattcaatgagtagttgtgaattgatggagttacagtagcactgaacagagatgaaaggcagcaaaatcagttagtatagtacagtcttccctaagtatcctctggggattggttccagaacctccgcggataccagatacccaaatcctcggatgttcaagtcccacaattggccctgaagaacccacagatagggggtgccaagtgtatttcaaaaccagtttgatacggaatttgaaaatgtgaactgtggtaagcagaataaagatgtccacgtcttaggctgggtgcagtggctcacacttgtaatcccagcactgtgggaggccgaggcaggtgcatcacttgaggtcagagtttgaggccagcctggccagcatagtgaaaccctgtgtctactaaaaatacaaaaaataaaataaaataaaattagctgggtgtggtggtgcatgcctgtagttccagctcttcaagaggctcaggcaggagaatcgcttgaactcaggaggcagagtttgcagtgagccaagattgcgtcacagtactctagttaggtgactgagcaagattctatctcaaaaaaagaaaggaaaaaaaagatatccacatcctaatatccagaactggtgactattttatgttacatggcaagaatgaattaaagttgcagatctaattaagtttgctaatcaatagactttaaaatagagattattctggattatccacattgggcccaatataataacaaagatcctttaaatatggaagagggaggcagaaggtcagagtcacggagagatttgaaaatgctagttgctggctttaaagtggaagaagaggctaaagaatgtaggcagcctctagaacctgaaaaaggcaagggaaaggattctccccgagaacctccagaaggaatgaggccgtgtcgacagcttgaattttgcccagtgagatcgatttcagacttcagcttctagtgctgtaaatgattatggttatttgaagccactatgtttgtggcagtgtgtcgcagcagcactaggaaactaatacaacaacaaagaggccttaaaacatttccagataggatttttctctctctactttcagctgtgaaatgcagttcaattcctctacataaaagcacctcccaagtaatatgtgctgtgactggcaacatgatttaggctgcctggtgcctgcaaatactaagaacaatattcctggcagacctccaggatattctgtcttctaattggctcaaattaattccctctactctgagcatttggaggagcaaagattttccacatagttgtattacattttttctactttttctatatatcctcatgactatgaatacaacataaatctaatgttgaatttactgaaactgactgtattctattaaagtataattataattataattatacagaaaagaggcagacatatttgctttctaaaacaaaaacaagattattttaaaattgagacataatttatgtaccttaaagtttacccttttaaagtcagatctaccaatctacaatttggtagattttaagatattcataaggttgtccaaccatcaccaatatctaattttagaacatttcattatgccagaaggatacccagtacacatcagcagtcactcctctcttcctcctcccacaaggccctggcaaccaccaatctactttctatttctatcgactttcctattttgggcattttatataaatggaatcacacaatatgtgcctttcctatctggctatttcacttggagtaatgttttcaaggttcattcatgttgtaactttatccctttttatggctgaataatagtcccttgtatgtacataccacattttgtccattcatcagctgatgttcatttgagttgttttcactttttagagattatgaataacgttgctacatgttttgggacaaatatacgtttgtgattctcttggttatatattaaggagcagaatttttggttcgtgtcgtaattttacatttaattttctgaggtactgccaaagtgttttctaaagtggctgcaccattttacattcccaccaacaatgtatcaggattttaatttctccatattctaatcagcacttgttattgtttgcatctttcttttaattataatcatcctagtgggtgtgaagtagtatgtcattgtgatttgcatttcgaacattttttatgttttattggcaatttgtatgtcttctttggagaaatgtctgttcagattctttgcccagttgaaaaattgggcgatttgtccttttgttgttgaactataagagtcctgtatatattctgtgcactagacacttatcagatgtataatcagcaaaaacttttttccattatgagagtcgtgttttcattttcttgatgatgtcctttgaagcacaaatgtttttaattctcatgaagtccaatttgtctaatttttttggttgtttgtgttttagatgtcatatctaggaagccattgccaaaatccaagctcatgaagatttacccgtttgtttccttctaagagttatataaactataaagtttctgttttatgtaaatccttttcatgttaattgtttaatacagtgtaaggtgggggcacaatttcattattttgcatgtagatatctacttgtcccaacaccatttcttgaatatttttccttactgaatggtcttggcaccctttctgaaaataaactggccatatgtatgggtttatttctgtactctcaattctattccatttatctacatatctgtccttatgccaatatcacactatcttgattctgtagatttgcaggcaaattttgaaataaaaaatgtgagtcctcaaactttgttcctctttttcaagattgttttggctatcctggttcatttgcatattcacattaattttaggaccagattgtcaatttctgcaaaaaaaccaattcagattttgatggggattgttttgaatctgcagatcaatttgggaagtgttgtctccttaaaaatattaagtctcccagtgtatgaacatgggatgtcttttcatttacttagctctttaatttctttcaacaatgttttgtagttttcggtctacaaactaaaccacttttgttaaatttattaaatattttattctttttgatgctatcatgaaacgattagtattctgaattccacttttggactgcccattgttaatgtatagaaatgtcattgaattttttatattaatctggtattctgccaacatgctggatttgtgtattagctctagtagttttttgttggattccttaggattttctatatacaatattgtatcatctataaagagatagttttacttctttctattctgccaatctctgcttttaatggagtatttaatatgtgtatatttaacgtgattactgagaaggtaggatttatatttgctatttgtttctctttgtcttaagcttttttaaaattcttctgtccttccattactgcctcctgcacgttcaacagacattttccagtgtactattttaattcccttattatttgttttgcattttttttgagttattttcttagtggttgtctgctagattacaattaacatcttaatttatatcaaatctaattgtggattaataacaatttaatttcaatattataccccaaattttacttctgtatagttcaaatgcctttctcctcctttctgttgttaaaattttatctttatatattgtgtgctccacaacatagatttttagttattgttttatgaaattgtcatttaaatcagaaagcaaaaaagttacacacaaaaaatacatttatgctgtgttttatatttggttatatatttaccgctcctggtgctctttattgtttcatgtggatttaagttaatgtctagtgtcctttaatttcagcctgaaggactccctttagtatttcttataggtcatgtttctggtgtattgatgacttttgttgtttatttggtgacttttctgaactaattctatgaagtctatattctttgtcaggtgtgtccactgaagtctctgctaggttagttcaatggtcagttcataattggacagagattttctaaaatgtcttgaaccagtaagtctcccagtctcttgctaacgggctctgtgtatgtgttagggcaagttaaatgctacgacagtcattgttctaaccaagattcagctgttttggaggcccggtgccgtggctcacgcctgtaatccccgcactttgggaggccgagcccggcggatcacgaggtcaggagatcgagaccatcctggctaacacggtgaaaccccgtctctactaaaaatacaaaaaaattagccgggactggtggcgggcgcctgtagtcccagctacttgggaggctgaggcaggagaatggtgtgaacctgggaggcggagcttgcagagaggcgagatcgcaccactgcactccagcctgggcgacagagagagattctgtctcaaaaaaaaaaaaaagatttttttcagaataaacactccccagattgctgcaagactttaattattttccagagctctgggaaagttattttgactattttttccagttttatggaggagcgaatttccagaagcccatactgtgccattttccactaagatgaacttttaaaagtctatggtgactactaatctctacgagtttttcccaattaatttctttgtttctgtgatgtaggaagttctgtctttcaagtacctattctgttctgcaggaaattgcctgtactttccacacaccagggctataagttttcgtataactgagagctgaacgatccttacgtggatttttttttttttctatttaggattctggctcttcaggaaaacttccttctccaatttaaaatggatgtaagtagtgacatttctctagatgggtttatgtcattgctgtttctctacggatttgagcaggaaagaagaaaggaaggcatctatttgccctactttttaacttatttagaaaacagacaaggatcagcatggaatcaagggatcttaaaggtcattgactcaaagtttacaaaatttgcccaggactctggaagaattgtacagctgaattgtcacattgctggactgacataatgttttttccttacacaggcttgttctactgaagaaaggaaaagggactttgagaaaatctttgcctactatgatgttgtaagtgtgcgtctttatactgtgctggccatctctgagtaggaaacttatttaacccctatgtggagccatcttacccaacagaccctaaacttacatgatgaataccaatcccatctgtgtgttctaggtcaaggtactctcaactcctctagaccttctgagaataaagtaaaagtagccaaaggagtacacatggttgagaagagaaaaaaatgacttttttttttgactccttgggcctaaactataagttttctccctcttgtaggactaagagttcatttataatatcatacacaaaaacatacaaccctcccacccaatattcaacccaaagaaatagaggaaaagtcatacctatttatcataaaaactattttttcttgtagaaccaattatttgatgaaaaggggagaatataaaaattataagtacaaagtatggcaaagagattgaatttcctaaggacatgatagtatgatgtaagaaggaagaaaagtagaaaagcagaaaaaatgttgggaaaggttataaggatgtttccctgaaactaatcagactagataattatgtgtcatgttctgagcagaaaacagtatcacctgggagaggcagtctagcatagaggtggttaaacacgtggcttctgtgaccaattacctaggtttgaatcatggcttattacctatgtggccttgggcaggttccttagcctccctgtgctttgtttttcttatttgtaaaattagggtgataaggataataatatctaccttctggggatgttatgagaattaaatgaattcaggtttataaagcttttatgagagtgcctgacaagtactatataagtgtttggtaaatacactaagggaatggaatttttaaaatgatatgttaaaggctcaggattaagaaatcacaaagagagtagatgaattattatagtggaactttagagaagaaacaaatattttaatatgtattgtattttatagatgttcatatttgcatgtgttataaaatggttagaaaaaaataaagggtctcatgtacagaccaaatgataattctaacatgttcattcaatgtagtctccctggatttaaaataaatattttaataatcaacatatcattgccaaattatagggcaaaataaaaaatttcaatctatacctcaaaggattaatattaggtacaattaacacttatctgaactgaagcctgggacctgggaagcaaatgaaggcaatatatgtcatacgactgcaatctgcaaaagccgaggaactcaaaagtatgacttctcatttggttacatggagctgttttcaatgagttattttaattcatgtggaacattcatgtcctgcatggagaacataaattggaacatgccacttctaaatctatttgcggccacacaagaatactgatacggtttatttacctaagttattgccttgctttttggcttaagaaactgatatttgggcaattggatcttttctttttcagagtaaaacaggagccctggaaggcccagaagtggatgggtttgtcaaagacatgatggagcttgtccaggtgagtgcacgttcttcttattatgaagtggggttgttgttttgatttattccattgtttatttgtgggaatcagtgagactgaaggttaatgtcaaagataaaatctagggatgtagtttatttaataacctttgaattgctatgaaacccaacaaacctccctcgctttcttaagattgtagtttaaattacatgaagctatcatacaagtatgtttttaccatcatttaaaggccatctattttaccaaaggagcacagtgccactgaatatctttctgttctattttttggttacagaaagtccctcttcccctcagacttggttattagaataactaaaacatttaattgaatttcacgtaataaaacttatcttcagaattctattttttttttaactaagaggcttctctaatacctagcctaagatggttatttatcggttaagacattgctgaggttggggcggatgaaatttagattatatttacatcacacagctgttttatgtaggatagacaaggtttaaaaaaccttcttcgaggtcctgttgaactgtattgaccagctacatgatccagttaagcagatcatttcctattcttccttttccatgggattgtgtcgacaatgaatttagtagtcttgtatccctagggattttttgaggtttgttcagaacacaatgattgtgttctggttgggccagatggcaaaaaattagagtagcaattatgaactgtgtgtggagttccagacttctttgaaaatcagattaacactatggaaccttgcagctgaaaaatgtgcaaatatcaatttttgcatgaatctccaggaagtttgtgtactgcaatagagcaggcatggataaaaccctttctgacatctaatcagcctgatgagacatcgtccgtgattcctttcttttgttattctcatcccagtgggtcccttgtctcctcttttcctcattcacttgttgctcctgttggagatttcacgggcatttgcacagccagaataactgatgagtattggtgtggtattgctttttctattgattgctagaggaaaatcccatttcactcattatctatttaatgtcagaatggcttctgtaatagaaactgagcaattatctatgggatattaaagttgcatggcagcatttgctaaattagagttttaatttgcttttgagagaatgaatgggacagtcagtctgtttttgagagctgcctggcctcttatgcattggagccaggggcagtgactgcctgagtgtagagcctgggggctttggaaccttacagcactctaccccaccaccccccagagaggttttggccttcttctcttccatgtcccacacatacagcccagctgtgagtgtggatgcagagtcacagtgagcagtcagtcattaaccaaatcaacctcccttcttctttgctcccccttttctttactctcaaacttgtgggaaacaattttttctcaggtcagaggtgtcatttgttgctgacaacagtcttgtggcatcccacgtcttcgccaggctgtgggaggcagctgggctgggctgagggattaagctctgcttgaatcagaatacatccgatttacagaatttgaaggggtggtttccagaggggctgccttggttgggggtggctgctgctcctcctctttggtaacctcattttgattctcttcccttctttctcttttccctcactatgaaaagaactgattggaatttttttttgtagatgaggccgtgtaaaatgggagacagtgctttggcctgtgacagatctgagctttaattccagatcagccatttatgaactgtatgtgtgtgggcaagttactcaatctctctgatacttgtcttctcatccattatatgggcacaacaatatttacttcccagggttttgtgctgactagaaataacataaacattgatcatagtccctgggatatcaaatgatttccaaaaataatagtctttattattttattagaacaaagcggccgggcgcggtggctcatgcctgtaatcctagcactttgggaggcagaggcaggtggatcacgaggtcaggagatcgagaccatcctggctaacgcggtgaaaccccatctctactaaaaatacaaaaaaattagctgggcgtggtggtgggcgcctgtagtcccagctactcaggaggcttaggcaggagaatggtgtgaacctgggaggcagagcttgcagtgagctgagattgggccactgcactccagcctgggcaacagagcgagactccgtctcaaaaaaaaaaaaaaaaaaaaaaaaaggaacaaagctgctgtaatctttggagtacatttctgagaatagttagcatttgaaagagaatttcataaaaggaatcatctgctcaatgcatggctatgccattctattggataatcctgtctaaaacaataatgtaaaaaaagccagtgcaaaagaaaacatctaaaagataggtatgattatgtcagatggcaattaactaacatattttagaatgcatagcttgaaaatttttgcttcctttctgattataaaattctctctgcatactatagaaaaatgttgaaaataaaggcaagtaaaagttaagaagctgatgagaattcgagctaagaattcggattctaggctgaccccctggggttccaggtctgattttaccactccctgccaatgagaccttgggcaagtcattttgcatctccaaacctcagtttcctcatctggaagatggaaattgtcatagatcctacttccataaagttgtcatgaagattacaggaggaaaatctgtataaggcaattaatattgtgctacttcactaattaataccatggtaataaattattactaaaaactcaaaaaatactagctatatcacatattgatctggaaagtgatatagctctcataactttagtgactatgatcattgctatttccatatgatttttgtaagagaaagcccagatatctataaccagtaattttgctggatcccttcttaaaaagtcatgatttttgaatctggataatcttaataatcttcaataactctgcctttcaattgtcattgagtttggcaatggtttccaaaggccagtaggagagatagaagtaaaatccaaaccaacaacatagcagacaagacattttttccagagaaaatgaaagagatgggaaaaatactagaccatgcaaaaaattagttggaagcagagatcagcctcgttcttcaatggatttatatcacttctatgggaaggtgaagatcctcgccccttttagcctctctgtttctgtggagctgctggggcagcacaaaggcacctctcagtgtaagcaccagccaatttgagacagagctagttcctagagaccaagtcagactgtggtcagtaattcaaaaggaatttattgggattctccagatgatttgttgagctaaaacatatgtacacagtagttcattattaatgttctcctccgaaaattgaaggtgcatacgtttactgtgcctttcctagtctttaatggatcttccttagtcttctaggtttctttaaaaatactcgccatataatttgtatgctgtagtcaaaggatggccagtagttgaatttcatatttcttggctttataaacagagtctttcctgtgacttttctctttattttcattttataaaaaagggccatgggagaagtaaacaaatcagtatttggaatttattttaaaagaaactgtcagagagcatataccatgggatcagcaggaagctggcccagttacaaagtctgggtcagggtttttggtgtttgcagtaataactctgaagtaagcttatcttatagttttttaattcttggacaatcatatgatgtatatgttgactttacatggacaagattatttggttatcaaaacaccccattccccaagctctgaaaaatgacacccaagtctttcctctgtcaatctgataagattacaggtctttgaggaataaacatgatttctttttttccaacaaatgtattgagatatgattgacacttaaaaaagcactgtatatacttaacatatacaatttgatgcatttggaggtaagtatacatccatgaaaccatcatcatgatcaatgacataaacttatccatcacctgcaaacatttctctagccacccccctccacctttttttgtctttttattttgttttgttttcttttatgtcaagggcacttaacataacatttaccgtcatagcaaatgtccaagtataccatacaatattgttaatcatatgcacaataatttctgtacaagatttttgtttgtttgtttttgagacagaatctcactctgttgcccaggctggagtgcaatggcgtgatattggctcactgcaacctccgcctcctgggttcatgtgattctcctgcctcagcctcctgagtagctgggattcacaggtgcatgccaccacacccagctaatttttgtatttttagtagagatggtgtttcaccatgttggccagacttgtctcaaattcctgacctcaagtgatctgcccaccttggcctcccaaaatgctggtattgcaggcatgagccactctgcctggcctacaaaactttttaacagcccgtagctcactcagagcagcataaaaatcaacacaagaatctacagcttaaatgagaaagtagaatggcaagaaattccagatctcccaagagaaggtagaaatatgaacactaacatcggaagccaaatacattggctgtctggaagtgatgggagttcctgcccacagtcctccctaaagttctttcttttccttgatggacaacccatttgctttttctctgctattgtcaggaagatgattggcaagaggggacaatacctcttgttattgatagattcagtaaagaattgaatctaacatgtgcctctctaaagagctagcccttagcaaaaatgtctcttttcacttttaaattgtaaaaatgatacatgcatcatagagaaatcagaaaccagaaaccagaaaaaacagaagcataacctctatgttctaacagactgactgtgaactgacttttctcctatgtatgtttttatatggttgaggttatagtgaataatagacattacaatatcatagtatattatttataatatagagtatactatatatagcctattacagaataatattaacagtcattcagtaaccacataatatttcacctgtggttagatcataatttacttaaacattcccctattactaataatttagatgggttcccatgtctgcgattcaaaacagtaatgcaataatatccttgtgcaaagatctttctctatatttggccttgtcccgggaataaaattactaaatcaagtggtttgtgtgctttaaaattcctgggatccattgtcaagttttagcaaacatctgaagaaagagcaggtgtgctttcccatttccttcttcaacgtcctttcctcaaacctgacttttcttcccctcactacccagaaagttgctgatgacttcattttgacctagctttgtctatcacggaagatagcattctggtatatatactatatgttttcgcattattatgttagggacttaacgtgctgccatctcttgggtgatgaaaaactttgaaaagagaggataggtggcaaggagaagaaaatgtaatcccaaagagtgaatatctaacaaaagaatgttttttgttagatataaaagaatgtggtggaaactagcgatgggaagaaagttgaaagactgaagaggttcttcctggagcttctcaaattaaagcactgctgggtacaccactctctaggagacttcccagtatctgagcagacgtttccatttgcctagtaaagtgatcctaaaggaacaccaatgtaatttcttattttcattttaaaaagcaatggcaggtgataatttgtaaacaagcagaggcttgttggtagagacctggacagatatcttaagcaataatgtcttaacttctgcctgtcgcctcaatgttttcaaacaccagtgtggccaataaatagcaaactggagacagaaaacatgttgtaattttgcatggttacagaataaggttctggttaattaaatattttgattggtagagaattattttaagtgggttacaataaaatgcacttaccatcagtgaaactctaattcagttcctctagtggtcagaatatggtccagtgttggagtcatgatgactctaggatagagatttgtgaagtgctggttaacagaaggcttggatatgaactttaattattttaagagaattggaatgtacaggaaagggtaggtgtatgacaaaaacaggaaggctgcatttgaggatagtcattcactaatttcatagatataattgagcacctactatgggcaagaattgggaagagaaggccagccccaaaggtccccctattgccaagattaaagggagacaggtcagcatttttcaatcaattttatttcagatccactctcacactgtcctatgagatgaaagaggaaaaagttacatttttacatgaaagattatgatacagtgtagtgataaaaaatatacactttgggacctgactgcctggatttgtatcttggttctgacatgtgtcagctgtgtgacagtgggcaagttaattaacctctctgtgctttagtttactcatctataaattaatgatgaaagtagatacaacctcctagggttgttctgaagattagagttaatatatttagagctcttacctcaggaacctatctgcacttatattagtcacttgttataaaaactgttgttaagactgaggctctaaaggtttctggtgatttgtcttcagtgacacgtgcatttttgagctgtggcatttaggtctcctgactcatattgagttgcccaatattaaaaacataactcaaaaggtccaaaggaacttcctttacatacatccacattcattcccacatcccctaatacacatgcattcatacaccaaaaatattttctactcacttgaaggaaataattactatggtgggaaacaaagtccattattcttcaattagaaaacaaaacaaaacaaaacaaaaacaaacttagaatagtttgaatgaggtaaatacattggcaaattaattcacactaatgtgtaaatgactaccacttgagtattttctaataatgggatttgccaaaaggatcctggggccgtttagtggagaaaagttttaccaacaagtcactgaagatgctgaaaagcaaacatccccacattgcactgtacaacaaatgaactcccaccagggggtctcagaatgcagcctgctgttttcaggacctctgagccacatttccttgggccacatctatacttgcctggtactggcagagaactacaagagaacctattgacaaggtcgagttacattgtggcctcagagtctaatcattcaggccactctccacagaagagtgaagttgatcaagtttatcttctggtcccagactttcagctcctgatatctctctgaataccaggcctactctggtgtttatttttcctgctctgccatctggctcccaatttctgttgctctttcctccttcctcctattttaaacctgctatcaataatagatttggtgtcagtcatttaccccattggacagtgcaaattaacgagtcttaacgtggcttggctagttaaggaacaatttttttttcttcccctactgatgatgtttttagtgattttgtttttggaagcaagaaaaccttggggcagggttgggtaatggagagtgcttcccagagcccctgaaatcaaacctgcgggtcgctgccttctctattcactcataaaactactccagtaatcaaggggcttggaaatttgactaaatttgttttttgtttttctctctgtacattgacttttaaatttagatttgtgaacagaagttttctgaaaaggaatttggtggaaaggctttattcccgttaatagtttgaaaacgggactgggcacaatggctcaggactctaatcccagcactttgggaggccgaggcaggtgtgtcatctcaggtcaggagtttgagatcagcctggccaacatggtgaaaccctgtctctactgaaaaaatacaaaattagccgggtgtggtggtgggcacctgtaatcccagctacttgggagggtgaggctggagagttgcttgaacctgggaggcggaggttgcaatgagctgagatggcaccactgcactccagcttggtgacaagactgaaactctgtctcaaaaaaaaaaaaaaaaaaaaagaaaagaaaatgggaaaatggaggacacacttttcagtgtaaaccagggtgcagagaacaaaagggggtttggattttacaaagtcagtgcccacccatgttgccagttagttctgtttgtgcaaataaaggattcaaacttgcttagttctgattggttattggagccaagttctgattggtcaatagagctgagtcctgattggttaatttaactgagttctgattggttggttcgggtgagctctgaaagccctaaaaagaaaaaggtgctggttttcagggtacttgagtaagctgtcatctctagtcaaaaaagggccacttggatctattttaaatttagggccagtggccgggcacggtggctcactcctgtaatcctagcactttgggaggccaaggtgggcggatcaccaggggtcaggagtttaagaccagcctggccaacaggatgaaaccctatctctactaaaatacaaaaattagccgggcatgatggcgggtgactgtaagcccagccactcgggaagctgagatgggagaatcgcttgaacccgggagacggtagttgcagtgagccgagatcactgccactgcactccagcagggacggctgcgacttcgtctcaaaaaaaaaaaaaaaaaaaaattttgggccagtaaaccacgtgagatccattttgaaggatgggctctttgattttgacgtttattcacagatgcatcagcacacatgtagtttcattagaccagccttttctccatgagaatggtatgaaattttgcaatgagcactcaattggaatcagaggactattgaggactgtctccaattgtcagaggactgttggactattcttgggctcaaaaatgctgccacaactttccagcttggcaggaagcttaagctttctctgcacctctgtttcctaatttgtaaaagaggtggaattatttacttcccagcattattgtgaagcttacatgaaataacctatggagaatcaatttgttaaagcattcctcacttttgcaggcctttgagcttgaagtaaaaaacttttcctagctaacatgtgtcacgtttctagctaacattctttcttgccccctaacatatcccttggagtaaatattacatccctagctcaaccacatgttttaaatttacattcagtataaccatttttttttaaaccagaggcacaaaaatctcctacaaggagataatgaaatgtgtcttctctcatcagtgcagcaaggcagaaatttatgatcataattgcctactttgcggcaaagtatctttactatggttgctaataaggcagtctttttctaagaactgcagggaagtgatgtggaagtaaaggttttttggcctgaagggacatgctgagaaatgaagctgttggcagaaaacttatccttggcagcatttggtgggatgaggcgatagactcattccctcactccctgtggcctgtctccttcaaggcaggacaccctaagcttagggagcatcagagagggtgttaaagggtgagaacaccattggcttgcctgttaacatgttacttttgtcgccctcagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattggaaacaaaaatgtactggtaattgcttttgtcttgtgacctttgaaatgttctacctgatggtttgactaacaaaccccttatctaatggggatcgggggaatggtggagaaggagagtgaagggcaatatcttaaaagaaatccacaccaccaatccttctatagtcctcacatgccctcactagggctgacttcctggtgagctggcattaaagtgagagctgccaataatcactttttattggaaggaggagaccagaacactcatcctggactggggtttgttcttaagtgcttggtgagctcacatggctaggcaggtagatatagagaagaagtatgaagaaaatgtttcccaagtaacccgggctcccctctccatcccttccttttccaacagtgctccccagcaaatctgggaccacgacagccttcttctaggtacgtgagtgcctctcatgggtgcctctgcatgctcctggccccaacatgtgccctgctctcttctctcctggaactctgatgccatccccatggaaaggagactgttggggcaaggggagagtttctgcagggtaggccccactttcctttactgtcttcatcctttattcttcataacacccctaccttatactagactgtgtagtaatttcaggcttagtgaagtgttacagataattcagaaaaattagtgtagaacagtgtatttagagctgttcataacccacgaattctgtttacaggggttcccttcattgcacaccgtcgtcctaacctgattttcttcccttcatgtcacccttacctccaacatatagataattcatattaagaactgctatttactaagtgctttctatgtgccaagtacttctaggtgctttccataccttaagtaatttaatcttcaccaaatccctgtgagataggtactatcatgatactcatcttagagatgaagaaaccaaggtagatagaagctaaacaatatgttcgttatcatagctcttagaagtgggaagtcagggagtctgacgctggaaccacgtgctcctaaccaccactttattttttaattttttttttttttttttttttgagatgggctttcgccatgttgcccaggctggtctcaaactcctgggctcaagtgatccactcgcctcagcttctgaaagtgctgggatgacaggcatgaaccaccatgcccggccaacaaccacttaattacagacaattttcacgtacctttcaggaagccttggccccttcctgcaggttctttctcacagtgggatccgccacacctcccagaagaacaattctccaagtccgggtcattcaacctggagtacactttgtaggagcttaaagagagttcaggaagcaccacagggtgaaccacacatgccagattcttctgttgattgtccaaatggtgagctaactgtgcacacatacactcttcacagaacaaacaaccattttcaggattgagactgcctgaacccacaaagaggaaaagacattctctatttccaggacatcacattattctgcagtgattaattcctcttaatctcctgttttcttgttgtgttttaagtaacagaagccttttattttaacatagttgaatttattttatatatatttattgcaacatattttatgtttggtttgagaaaacccactctatatgtcacaaatgcattctcttccactatcacttttttaaactttaaaaaaattatagtcatagatacatatgtgtgtgtttgtaacataacaattgccatgtaaccattttaagtgtataattcagtggcactaattacatttacaatcttgtgcaatgattaccactatgtctaaagtttactcatcaccccagacagaaactctgtacccactaaacgataactcccaatttccctcttctccattctctgttaagctctaatctatgttctgtctatatgaattcacctattctagatattttatataagtttcatcataaaatatttgaccttttgtgtctggtttgttttactaagcatcgtaatttcatgatttatccatgttgtagcacatatcagaatgtcattcctttttattgctgaattattttccattgtatgagtagtctatattttgtttattcatttgcctgttgattgacatttggtttgtttccaccctttggttattgtaaataatgctgcaaggaacattggcatatgagcatcagcgtccctgttttcagttcttttgtgtatatatgtaggagtggaactggtggttcatatattaattctatgtttgtctttttgaggaaatgccaaactattttccatatagctgcaatattttacattcccactagcaatgtaagaaggctctaattttaatctcctgtttctaaatacagctttttctggaactggcaaaaatcagaactagacccaaggctgagccatatctacttaatttatgactcttcctttagctacacgaagagagtctttgaggtttgctgctcctgcaatgggtgtactgcattcttagctaaagatgtgcatcctcttccgtgtctatctagtggtggctgagaggaggatgaggatgggaagggacgttttattcttttaggaataatttgttcagacccattgaaagaagctacttaccttgagcaccagcaagcttttagtcatggcacatagctgagactctatcagaagctctcaggtttcctgctctattacaatcttaagttgaagacctttccaagcatgcaaagaaagggctggtgaggaatgagttaactatatcctataatgtaggtgctggtagattcatttatggatggccaaggaagataaatggacttaggtttttcttgaaaaaccagaggcagatcagggagctgaagtagaggctcctagtaggcagaagtctcttatcagagcccatgtaatatatatttgatgtgttgggaaaaagtggaatggcatcctgaaagctgtgctttggtccaaagatgtgtgttcatccattcattcaacaaatacctattaagaatgaatgaagccttcttcaattggtcaggccctcagacaccactccctcccctgaattatgatcccaggtagtcactgtcctactcatctgccaactatacctccaaatagtgttaatttatatttatggatactttccttcttaagtagattgtaaagttattgataccaaggaattgtgtattgcaatcctttgtatatgaagcattttagttgtaatcaagaatgctgttgatagtggtggtggtgatgctgttggtggtgatgatggtgttggtggactaagaatctactgcacaacatagttggggattgggcggtgcttaatgtaatcttttattgggtctacatgattataaagcaaaataaaaatgtaattatttttgctgcatagtgtagcctaaaataaatagttaagtgatagatctcaatcactcatttttgtaaaatttcagtaaaattggtgtgggtatccagctttactttatctcttgatattgcaatttctggtcaattcagccccaaattctataaaacccagtagctggagtggacttaatataacacaaataacagactttctgattaaacctgaacaaggcttggtgtaaaaacaacttcagaggccttactgccagacccataagcttcagtttttcttcttgatgacttatttgtttataagttcttgaaggcaaaagcttataggtttttgtaggtttttattttagcaatagttagcttatttttgctttatcagggtcagggatacttagagccatgacctcctctgtgagacttttaggacaatgttgagtttctaactatcataacaaacagtcacaacctgggagataaacacctgcttctgtctcctcaaggaccttctctcttcattccctccagggttaaaggaactaattattttgactgtggaccttcccttgtttttcttaacattctgggccatcttccactgacatcagtcccactctcctctgctcccacattccctccagcctccctcctctctctgcagtgacttcacagctccctagtctctcttcttgacctttttctaatctcttctttccaccttccatttcatcccttttgctcttgaccaattaaaatgtgccctttcttcttggatctcaagtcctaacttttccataaatctgctccaatactctccactatctcttttcacccaatttctattattctttaattaatatccataatttaatcctaattctcctgtagttgctgtatctgtgtgtgtgatacatatgtgtgtatgtcacctccaacgaggtgaaaaccttccagtaagatctggaaccctggttttagactttggtagcaactccatctggccctgccagaccactacatgagtatacatctcctagcacagttaccagcacaattgagaaactttcatcaccgagcgatggagaaagccttgcctctgaggctggttccctgctatttatttccaattctgactcttcctagctgtatagcctggggaaaatcaacaaatctctctatatatccatttccttatctgaaaaataatactgacttctggtgaaaatgatgctctatgttcaggatttgagcaagcatatccccgggccaccactccaaatgcatagcactgtcagaatcagtgataagaaataattttaaaaaataaggctcacaaataagacgagacttttcctgtaggataaagcagagcctgaggtcttgctgggctccagattctgaggcaagaaggggcagcagccggcaccagaaaagtccctgagcagggagaaaggagtgggtctcactgctcaaaaccaggggctggagatggacttcacaggcatgaaaagaggctggaaaagctgagaggcgctgctgggccaaaggcttatgagtggctcaaacctagggagctggacctgtgccaggtcactcactgcaccattatgcaacctctaacatccacagcatttttagagggaaggagtcacagtcccccagtgcaaaatgtaggttttaagctatggccctaaaaggccagtcttatgtaagcaccaagctactggacaagaacttagaagagacacagagagaaagagaaataaaaagagaaagagagagaaagagaaagaaagagatcattttttattcacataagcctgcaaactttaattctaaagctcataaggttagaaatagaactatcagcaatccttcttctgagtatatgcccaaaagagaagaaatcaccaccaccttgtaaagatatctcaccctgatgttcactgcagcactattcacagtagccaagatatggaaaaagtctacatgtccattgacagattaatgaataaagaaaatgtggtatatatattcagccctaaaaaggaaggagagcctgccatttgccacaacatgaatggacctggaggacattatgctaagtgaactaagccagacacaaaaaagaaaaatactgcatgatctcacttatatgtggaatatttggggttttgtaaaaaagagctcaaatacacagagatagaggatgaaacagtggttggggggtgaggaggggacggcacaggcagtcgggagatgtaggtcaaaggatatagaatagcaggtatactaggatgaacaaatttagagatctaatgtacaacatgaggactgaacttaataaaattgtattaggattttatgttatataagtagattttagctgcccttgtcacaaaaaataaccacgtgagatgacagatattttaatctgcttcattatagtaactattttactatctatatatgtcccataacatcatgttgtaagacccaaatatatgcaataaaatttactttaaaaataaatagagcaaaaagtttttaaggtcattgggaaaaaagctcatgagaaaagctaatgctgaagagactattacaaaatcaatacccagggagtaaacaaatgaaataaaaacaatacagccatataaaaataccttcaaaataggtatgtttgtatttgcttaaatatatgtaacttatgtttgtaaaggaatctgtaacttacttgcctccaggaagaggcactgggtgacagggtaggaaggagacttcacggaatattctttgtaccttttgaattttgaaccacatgaatgtattatctacttaaacagatatataaacataaaatttaataattataataccagtatatgtttgcttagaactcttacaataataaaggtataataattaaaacaattattttaaaataggcagaatgaaatataagcaagtggacataaataagaacccattaaaataatgaaaataaaatatataattactgaaataatatcagtgcaagaaataacttttgacgggtcacagttggaatcagtgaatacacatattgcagacacttcacacaggaagacacacagagacacactagataaaaattaaaaagaagataatagtttttagagtccacaacatatgtctatagcaattgcatacagagaataaaaatagtggatcaatacaacttgaagagataacaattgagtttccagaaatgaagacatgaatcctccaaatgtgaatacatattgaattctaaacctggtaaataaaaataaacccacaccagaaactctatattgaaaatgtagaaaataaaggctaaaaaaatctcaaaagctgagaaaaaggagaaaattatatactaaataataactacattgccagtagatttttatcagcaaagacagataacaaatggacagtggagtatttccaagtaagaaaggaaaataactgttaatctaaaatgttacctatctaaactaacactcaaaattaggatgactttttttttttcccccttgagacggactctcgctttgttgcccaggctggagtgcagtggcgcaatctcggcgcactgcaagctccgcctcccgggttcacgccattctcctgcctcagcctcctgagtagctgggactacaggcgcccgccaccacacccggctaatttttttttgtatttttagtagagatggggtttcaccgtgttagccaggatggtctcgatctcctgaccttgtgatccgcccgcctcggtctcccaaagtgctgggattacaggcgtgagccaccgcgcccggcctgaaagactttacatagacaaatattttgagggctttactcaacttccaccatatattcttattaagaactacataaggatgtatttaagcagaaaactaaatccaaaaggaagtgtgggatgcatagtatggaaaatgattttaaaatatttaagctttaaaatggacagagatttggctaaaaattgatttgtaaggatgttcactacagtactagctgtaatatacaaaagtatggaaacaaccaagatgcccaatagtgttactccaaactttgcaacacttcatttttattaaaaatctggactcttaaaacattttttttgagacggagccttgctctgtcgcccaggctgcagggcagtggcatgatctcagctcactgcaacctccgcctcccgggttcaagtgagtctcctgcctcagcatcctgcgtagctcggaatagaggcgcccagcagttttgtatttttcagtagagaaggggcttcaccattgttggccaggctagtctcgaactcctgacctcaggtgatctgcccgcctctggaagtgctgggactataggcgtgagccacacgcgcggcctaaatagctgtctttcgtggattacataataatctcagaaactgtctttgtggcctattttcctgggagtagagattaaagtattttattgaaaaaagatggcaaaagtatagtgttggaaaggagcagctcccttgtctttctcgcagggaatgcgatgtagcagtgacctgcttcttccctgccccgctgctgaaatctctagggcagtacacagagaaccaggttatggtactgtaacgctatggcagtgcctaagggatcaatgtctacaactcctgaagccccagcggacttgttacagggccctgcagtttgtctcgttgtctgtaggcggcttatgttaaacacctcaattaaaccgtctaccgtaagaacatgtaactttctctcaagctcttggtctatggataggtaggcttggaaaatgagtggaaggtcttcagaacgcagcaggcataaaatgtccaacagtggagaagcaaagctttctcctgctgtcagaagcctgctgaacagcccgaatcctcctggctgttctgactgagcttcacccctttctgccagtggataacttgccagcggcgtgctagttctcgttctcgcgttcctccagcagtataaagctctgaacgaacagttgtctctgtgtccgcttgctacggtctcgggggtttttataggcacaggatgggggcgtggcaggccaagaaggtcttgggaaatgcaacctttggtcagggaaaaaaacaatgcctgtcttcacctaggtccgtgggcacaggctcggggcggacccctagccaaggaccacgccctcctctacccagtacttctctttccgcttcggtaccatttaaacggaccatgcccttcctttccatatcagtattacgcaactcaaaaaaggcgcaatgacattttaagattaagagtacaaacaaaaaattacaaaaaagtggacaggaatgaattaggaattcaaagtaaagatcagattattcactattttagaagtagcattccagcaacttagagatactgtttaggaaaaagaaatgtgtctatcttgactctattccgttatgttaaattaaaaagaaaaggccaggtgcggtggatcacgcctgtaatcccagcacttgggaaggccgaggcgggcggatcacgaggtcaggagatcgagaccatcctggctagcacggtgaaacaccgtctctactaaatatacaaaaaattagccgggcgtggtggcacgcacctgtaattccagctactcaggagcctgaagcaggagaatcgcttgaaccagggaggcggaggttgcagtgagccgagatcgcgccactgcactccagcctgggcaacagagcgagattccgtctcaaaaaaaaaaaaaaaagaaaaaaattacaaggaaaaactcctaattgtctatggagactgacaatggagatgcgagaacgttgagggttgggtggcgatgaccttcaagaaacctgatgcattttgtggtatttcttatgctgtgattccttctcttccattatccatctttatcttgtcataataatctatccattatcttcctttaaatatagaattagtgcttgcctaattggctttcctggaatctaattagttttaaacattttctcaccttaattttttgtatgtaaaaatgaagatggcgtttgcaacagagttgaggtaatcgttttcacagggaaatcatttccaaggatttataactgtgttcactaatttgttagagcatgaaatgatgaactccatttttttttcttttgcactccagattacagtcaagggaacatctttcttcttatacccatcataaaaagagacacaatagccaacggcttgcctgccatctagtgcttacctattaccagaaaaacttcatggtagtgaaaatacgatccttcactactaatttgacttcattatttgcaatcaacaagatcaaagccaactctttggcacaatttcttttgctagaagtttaagaaagttcactgggttttttatttatggcaatctcctttgatgtttattgaaatagttcaataatgactaaaattttcaagtt

SEQ ID NO: 353 - DNA, 36977 bp, Homo sapiens
accaaggaggtgaaagacctctacaaggaaaactacaaaacattgctgaaagaaaccatagatgacacaaacaaatggaaacacatcccatgctcatgcatggatacaatcaatattgtgaaaatgaccatactgccaaaagcaatctacaaattcaacacaattcacaacgatactaccatcattcttcacagaattagaaaaagcaattctgaaattcatatagaaccaaaaaagagcccgcatagccaaagcaagactaagcaaaaagaacaaatctagaagcatcacattacctgatttcaaactatactataaggccatagtcacaaaaacagcatagtgctagcacaaaaataggcacatagactaatggaacagaatagacaacccagaaataaagccaaatacttacagccacctgatccctgacaaagcaaacaaaaacataaagtggagaaagcacacccttttcaacaaatggtgctgggataactggctagccatgtgcaggagaacgaaactggatcctcatctctcaccttacacaaaaatcaactcaagatggattaaggacttaaacctaagacttgaaactatacaaattctagaagataccattggaaaaactcgtctagacattggcttaggcaagaatttcatgaccaagaacccaaaagtaaatgcaataaaaagataaatagcttggacttaattaaactaaagagtttcagcaaaaggtatcgtcagcagagtaaacagtcaacccacagagagagaaaatcttcacaatctatacatctgacaaaggactaatatcccgaatctacaataaactcaaacaaatcagcaagaaaaaaacaaacaatcccatcaaaaagtgggctagggacataaatagacaattctcaaaagaagatatacaaatggccaaaaaacatgaaaaaatgctcaacatcactaatgatcagggaaatgcaaatcaaaaccataatgcgataccacttacataatgcaggaatggccataataaaaaaatagtagatgttagcgtggatgcggcgaagagggaacacttccacgctgcagttgggaatgtaagtacagccactacggaaaacagtgtggtgattccttaaagaactaaaagtagaacaaccaattgagctagcaatcccactactgggtgtctactcagaggaaaagaagtcattatacaaaaaagatacttgcacacgcatgtttatagcagcacaattcttaattacaaaaacgtggaaccaatccaaatgcccatcaatcaatgagtggataaagaaactgtggtatatatgtggtggaatactactcagccataaaaaaggaatgaattaatggcattcacagcaacctggatgagactggagactattattctaagtgaagtaactcgggaatggaaaaccaaacaccttatgttctcactcataagtgggagctaagctaagaggatgcaaaggcttaataactacacaatgaattttggagactcagggggaatgcgtgggaagtgggtgagggataaaaggctacaaataggatgcattgtatacttctcaggtgatgggtgcaccaaaatctcacaaatcaccactaaagaacctactcatgtaaccaaacaccacctgttccccaataacctatgggaataaaaaattgttttaaaagaatgaaagaatataaaaataaaaatgtctctctttccttttttagaaaaatttcaaaaaagtttctttcctttcttttctctaccaccacttctacttctatattagttatttactgctaattacaaggacaccaaaacttaatggcttaaatcaacaaacatttattttataattctgtgagtgaggaattcatgagcaacttagctgagtggctgggcccagggtatctcatgaggttgcagctaagatgtcagcatcttcagggctgcaatcatctgaaggcatgactgaagctggaggatctgcttccaagttgttttattcatctgactattggcaggtggtctcaggccctcactgctattggtgagaaggctcagttctttagcacatgggcctctccacagtgctgcttgagagtcctcatgacatgtcagctggcttcctccagagtaacaaaagagagagcaacaaggaagccacattgacgtttatgatatatttcagaagttacacactgtcatttctgccatattctattcattagaggtgagtcaataaggccagtccacaggagaataaagttccatcttttgaaggaaagaaggaaggagtatacttgtgtacaaaaacttaaactatcacacctccccagagacaataacctttcattgtttcttctgagtctttctagaaagtatgtatgcatacacaagcttatagcccctttttctgttaacataagtaaaatcacactatatagactattctataccttattttttccattcaatattatcttgagaatcttcctaaatcagcacatacatatatgttctaatctttttaatagattcaaattatctaactatatgggtatttaaatacttgaccagtccctgctaatgataatacatgttgtttacagttgtctattatagcaaaacaatactgtaaggaagattttattttttttttttgttttcctttattttggaagattttaatatgcatatttttgccaacttctgtgagaacatctacagaatcaagtccttggagtagaattgctggataaggggatacacacatttgcaaccttgattgattatgcctaattgtttctaaagagatgactggttgatacattcacctgtattgctaagagtccctttccctactcttgtcaggttttcatctatctttaaaatgtttgccagtctgataggtgaaacaggtatttcatcatccattgaatttgcaattctttagttaccattaagtacatttatcagccatttttattacttttctgtgaactatcctgtattgtgtgagtgtgtaaaacaaaagaaactagtccttatctaccatacatgctgcaaatgttttcccccacttcgtcatttgccttttgactttaattggggtttttttgcataactttttttttttttttttttgcgatggagtcttgctctgtcactcaggctggagtgcagtggcgtgatctcggctctctgcaacctctgcctcctgggttcaagcgattcttgtgcctctgcctcccgaataatttgggttacaggcaccctgcaccacacccagctaattttcatatttttagtagggatggggtttcaccatgttggccaggctggtttcgaaatgctgaccacaaatgatccacccgccttggcatcccaaagtgttgagattacaggcgtgagccaccgtgcctggcctaaacttttaaatagtcaagttttaaagcaaaatttttaagaggtcaaatttatcaaaaccttatggtttctgggattttttccccaaacttagaaatatctccatttcatgactcatttaaatatcacctatgttttcttcttgcatgtttatggtttcaatttttacctttaattaattgctcatctggaatatggattaagaattgagaagaatatgtagctttgtttttattcaaatagttttcccagtaccaattattaaataatccacttctttccaataatttgaaatatcttatgctatgtttccctctgcttggcaggctatttataaactctctttgtttcattgatctgaagcgtccctttaagggaaattgttgaagtactgagaggaggaaaaaagttcagcagctgagaagttcaaggccagaaaggaaacacagctggggagtgagaagaagttggggtgaggatttagggagcactgagaatgcagaaaatatatagatatctaaattatataattgtattttaaaaagcaattgtgttgcttctcaaaacaactaaaccaacaatgaagacttgcccaggtcctcagaggatgcacattaattaatagaagataggtgtgttaattagttcaccaattgtttctaaaatgcttgaatcagcctctcacaggtatctattttccactattatcttctgtctaactcttgaactcacgttgttttttctgaaatatgttgttttcaggatgaatctgaattgatgtgtattccatacaggtgggatccaaaataaaaagatcatgctgcattttcctgatgattagttgaagacactgtgagccaggcactaggcatcacccctttttatatcactccgtctttcttgtagcaataccataaggaggccatcatcatcctcattttgcacaggaaataaaatatgtatttgcccaaagtcatcctgttgttagtgagaaagctgggacccagtttcacccccatctggtgcagaaactgtgctcttgccaggacacaatatggcctttcccatgtgatggatagggtagagggaaaaaacagcatgggaagctgaaaataaccgggttttccagagaagagaaggcatggagaagaatgactatctccatccagaatgagcaagagggcatggcctcatggactctgatagagaatgacttagaaaaccccaagcattctgtccttcttcccaatctaagtgtgatataagctggtgttacactgacctcactcaagttccccatgtcatgtattaggaaatgttctgctctctggcagcctctaggcagaaacctgatttgacctccctggcttcctaaccacccaagccttgtagctggccctggttctggggcccactgaattggagcatcaccttacctggctgggggcaggcatggagttggcaggtgctgaggaatgagaaattcagttcagcctggatccctgcaccctcctggagggttcccgcaggcttcttctgccattcctccttgctgctacatgaccacctgctgctgctgagattgacacctctgttccacggacctgagccagctgggggttcatcttcatcaaatcaaacctgcttacaagtggcaggtggctgagagaggcccttaagctccccagaaacaatcctggtttcatgttccaacccttccttaccttttccccaacactcacacaagattgtcgcatacccttgtgcaggttatataccacatgatgtcatggggaatataaatcacaatggcttctgattcacatattcttacctgtttgagaatttgtttgggaaagactcattaccaagtccctaaacagtagtcccccaggacaacgtacatgaggtatatgagagtcaagaaaagaaccaatgaaaaccagggatcatctgataaagttcagagactgcttccacagtatttcactgtatacatttgtcaagtgcagataaataatttctactctgttcacttcccagaaatattataagggtaggatagactcacggatgtgaaaatacattgcaaagtaaaaagcatcaaggaatgagagcggttttcttgttgatgactatcagctaagcagtatctatggagaatggactttatgttctctgagaacctgtaaacatgtgtttcctgtgctctctgaagcactgtgagaaatccatgcatgcactataaagcagcaatgtggggcagtgccaaggatatctaaaacaaactaactttatcttacttatgcaaagttgctatatgtggaattattttaaaatcagtaagattaggaatcaaattaatgaatgaatatatactaatttatcacaaggtgcctaagacaaaaaagagaaggcattttatatgagaatatctaacctaaatataaaacccgaagctataaaacactagaaggaaacataggggaaacatttcaagacatacatctggggaaagatttgatgagtaagacctcaaaaacacaggcaacaaaagcaaaaataagcaagcgaaattatatcaagctaaaaccttctgcatagcaatggaagtaatcagcagaatgaaaggacaacctgcagaatgggagtaaatatttgcaaactattcatcctctgcaaggggttaatatacaaaatatataaggaactcaagcatctcaacagcaacaaaacaaacaatgcaattaacaatgggcaaatgatctgaacagatatttctcaaaggaagacatacaaatggccaacaggtatatgaacaaatgcttgacgtcactaatcatgagggaaatgcaaatcaaaaccacaatgagatatcacctcacccttgttagaatagctattaccaaagggacaaaaaaattacatatagtgaagccactatagagaacaatatggaggttcctcaaaaactacaaatagaactactatatgattcagcaatcccagtagggggcatttatccaaagaaaagaaactcagtatatgaaaaagacatcttcattcccatgtttctggcagcactattcacagacccaagatatagaatcaacctgggtgtccaccatcagatgaatggagaaagaatatgtggtatacacaatggaatattattcagccataaaaaagaatgaaatcctgtcattcgtggcaacatagatagacctggaggacattaagtgaaataagtcagaaacaaaaagttaaatactgcatattctcactcgtatgcagaagattaaaaaaagttgatctcatagaagtaaaaagtagaacagaggataccagaatttgggaagggtagggaaaggagaggatagggagagatttgttaaaagatacaaaattataactagatagaaggaataaattctagtgttctatagcactgtaggatgactatagttaacaaaaatatgatcatatagtttcaaatagctagaagaaggatattgaattttcccaaaacaaagaaattataaatgtttaagatgatggatatgctaatagccttgatgtggtcactagacattgtatatatcaaaaaatcactatgtaccccataaatatgaacaaatatgtgttgattaaaatgcttttaatcaaaaacaattaaaaattgaagatttttaaaagaatatctattaaatatatctctccttgaagaacttataatccaatcagagaaaacaggttagcccaagaaacaactggaaaataaatcaagacagaatataatcaggctgcaagtggggtatactttcactgatgcattcatgccttccgggactatttattaggtaccctgtatggtttggccctgtgcttggtgagggagacgtaaagtcacagccacatccccaagttccctaaagtctagaggaaagatagacaaaaatatcaaagatcctaggtcaagggatatacctaggggtagaggttgcacagagaactgtggaaaaacacacaggtaggcagccaaatgagactgggctgccaaggaagacttcctaggagaggtgaccatgggaatgagttttgaacaacaagctaggagttactgagattcaatggggtgggagtggtggtactccaggcagaaggaacagtatggaaggtggatgggaggtgctttaacaacaaatttaggaatttgagcttggtcctgaggttttaaggaaactctggagacacctgagatgagggtgaggggtgcatgatcatattttcactttagaaggttcactctgacagccacagtgtggaggtagtattggaagatctaagaggcaacttgagctttcctagaagaattgagaccccttgtccctaaattacctctctcaccagttcaatgacacttggcattccatcggtaaagctgtatttccttaaccctaatatgcaactgtgaacccttgaccactgcatcaccctgcaagaatggagtcatactcccggcaaccctcggccatttacactgagtgttagcaagtttcaagtatcttcctgaggatattattttattttgttcttttattatttttttattcatctaattgatttatctaactgctagtctgcacaaagtcctgtgatacagaccagaaacatggttctctcctccataattatagcccaggaaaaggagggtaggaaggaaaggcgatggaacagaccagcaaacaaacgatgacaacacagcacagcacgtgcgaggaaggaggtctgcacacagggagcaaatgcccctgcattctttcaaatacctctccagcacctatgggatgccaagtggcgctctaggtggtaagaatcacatggcaactagtgctgagcacctgaaccttatatctgggggaggagaggaatgataaacaagaaaataaataagtacataatgtaattgcaggcagagatgatactgaggactgagggttaagaaggagctgacccagaggatgaaaatgggttgggaagaccacaggtgcaaagatggcttgggaactgtggttgggtgggggcaggtgaaggaggggaggcacagacagtagaccagcctctgggctgggtcctgaacctgaagggcctcctgtgtcgatctccagttggaacttttttatttttttttgagacggagtctcgctctgtcgcccaggctggagggcagtggcacaatcttggctcactgcaagctccgcctcctggcttcacaccattctcctgcctcagcctcccaagtagctgagactacaggcacccaccaccacacccagctaatattttgtatttttagtagagacggtgtttcaccgtgttagccaagatggtctcgatctcctgaccttgtgatctgcccgcctcagcctcccaacatgctgggattacaggcgtgacagttggaactttaagaagagaacaatgaaatgtcatgaaagggttttaagcagggaagagaaattatcaatttcattgttttcaaaagtcgctgtgcttgcagagagtgaccaagaagttgaaggagtcccatgagaagggatacagcctgagccaaggcacggccaaagggaggaggaggaacagaacacaggactggctgtgtgtggtgaagaggaggtggtgtcaagggggacttgcacatttctagctcagctttcctagaaggataatgctgccatccaccgaatcatagaacctagaagctgggggacaagaggaggcagagagagtatggtaacaggctctgtgggcctgttgaggtggagaagtctgcaagctgctgaagaaacgggtctggctctggggactcgcagctgattggacatgagggttagagagactaggaagacccccaagtgccaagggaagggggcagaaggacagggaggtggctagcagcaggtgtcaggtcactgtctaagggagaaactgctccacagttgggtcaactgctcaaagagcaaacatctgtgtatctgccctctgcattcttgaccaggcccagagacccaacctaagctttgagaagggaggtaggaaaggagggagggagggagggaaggaagggagggagggagggaggaagagagggagggagagagggaggaagagagggatagagggagggagagagggagggaggaataagggaaggaaaaaagggagaggagaagggaggatgggatggaagaagggagggagaaagggaggaagagaggaaggaaggaaaggaaggagggagggagaggaaggaagtgagggagggaggaaggaagggtgagccacatataaacagcataaagacaacagttttctgtgaggggatggcagccacaggaaatggccctgtttctttctcaccctctttcctgtttcctgtcctggaaaatcatcccagtgattcccctcttggttttccacatgactaaactccacggggcttgaatgatcagacctcaggctgccaggcttcctgtccccagttcctccggctcccgcagagcccacagggacctgcagatctgagtgccctgcccacccccgcccgccttccttcccccaccacgcctgggagggccctcactggggaggtggccgagagcgggtctggcctggggtgttcagatgctcacagcatggaaaagtccatctggctgctggcctgcttggcgtgggttctcccgacaggtgagtgtctgctactctctctggcccatgctcgggacagaatagatgctgaaagcatcttaggtacagtctcccctggaaggcaggaagcaggtgtgcagagcctccaggcctgtggaggaggaagagctgcgcttggggcctgtggtgccagaagccagaagttcaaatcagtgctgtgtcttggatttcaggtgacttgagacaggcactccatgtctctggcttcagggtggctgcctatataaaggctacttgccccacccattgctgcgagcatccagaggacaataggccaggtacagagaggacatcacaggctctgaacaagcttcttgtgctgctgtcacccaagtgccgtgtgttttgatgggcacagcctgaggaagaagggcggggagtgcatgggcgtttggggacagtgctgatgcatgggagggggtgatttcatgtgggggatatagtgagggatagaggccctcccagcaggaatcccagtgggtgagtgggaacactgtggcaggtttaagcaacaatgtcatcagtcacttagctcggtgacttggtatcctgggaacagtgtttcaaaaggcacagggaccatctgcatcagaatccctggggttaggagagggcatttgctaaaatgcaggttctttggctccaccccagacctgcagaatcagagtatcaggcagcaagtcctaggaatctgcattttcaccaccttcttgggtgattctgacactcgatgcatttgagggcacctgggattaatggcaaaggcaatcctcagagcacctctctccagatcccagtccttaccccatccccatcctaggactcagcatccatgccactgtatgctcggccatcacaggccacacactgacatcatggtgtcctgagctgttagtcaacattccctgtatggggtcctggctccataactggatgataaactcccacaccttagacccctttgccctcccatctggcgtgtactcagactggagtccagctcggggctggtttgggcagtaacagcaaacctctgcacagctgtcaccacatgctgggcactttagtaactcacataaggctgaaaaccctatgagaaaggaactctgtttgtttgtttgtttctctttggagacagagtcccactctgtcacccaggctggagtgcagtggcgcaatctcagctcactgtaaactctgcctcccaagttcaagtgattcttgtgcctcagcctcccaagtagctgggattacaagtgtgtgccaccacgcccagctaattttttaaatttttagtagagacagaattttgccacgttgtccagcctggtctcgaactcctgacctcaagtgatcagcccgccttggcctcccaaagtgctgagattacaggtgtgagccaccatgcccggcagagaaaggaactcttccctatgaaacattctcttttcacagatgaagaacatggggcccagaggggctcaacaagtggcaggggtggagctgggatttgaacccaggtgtgtggggcttttggctgggcccccccactaccccaccccacacagccatggacccttggtaggcactgacagggaaggagctatcttttcccaagttgacctaacttagccatctttctgggatgatttagggttgggtcccactgagacagtggccagacccaagtggtcaatgggagaggggttgagggtgtggatgttggcagcagggcaggtctgaagcccacctctgctgtttgctgtttactggctgcatggccttgggcaggctgtctacctttcttgagtccctgtaaactggggtccctgccaccttgaagaggagctggggagattcattagacactacatcaaaggcccccagcacagctcctggccctcagtggccgcacgataaataatggccatgaaaccttgccaaagtcacagcgtttcaagagagccgaggctttggggattttaggtttagggtgatttctttttttctctcctgttacgggtcagctgctatgaatcagcaagacacaaaggatttagaggaagcatgggctgtggagtcacatgttcaaaaacaaacgccaaaccacacaccttctctgttgagattactgagtgcagccaagccactcgcgtgagccgactcagctgcagaaagtcattttctttacaaacagcagctgcttcacagttagaaccagggtggtccaggcccccacttcctgacgctcttctggctgctcttcttctgggagcctctcctcatggctcagccagaagacatccaggccacggcctgggcaggaggcccgaggagcaggctctgctccaccaccgtgtgtgcaccagaggctctgtgagcagacgcctgtgccaacgcaggcccgccagtcgtggtcccttccctagcccagaacagccccttggtgagagaaaagtgggaagcatttgtcccagaaaggccccttctactttccatgtcctccccttcatgcaggagacccccatactcgacacccagtgcccagcagcccctaatctcccaggggctccccacatagcctcccaggtcctcctccatctccccccatatctgcttttaggaagctagagatgccagggaacgtggggcagggggaagaacactggtctgggagctccaaccacccgagtgaccttggacaaggcctcaggtggtcctcaagcctgtgataggcagatatcacaaccacaaccactgtcatcttcagaaccccttgtgccaggcctgtgacaaacagttcatttactcttcagcacagccttgcaagtgaggctcctggcctctgcaatggggatttggtgactgccggggcatccagcctaaatgggaagcagaggcttctgagtgtgcatccacctctcccgcaccctcctgcagtgggcagggagcctgggcaaagcctggtgtggagagctatttacttcgctagttctgaactgccgcagaaaaacaaacccaaatggcaagacaaatagcagcggtcacccaaagatgcaggggtgcttattcgggacacaggcaaaggtcaggaccggaggacatgggctggtgtcacagcccaggaggaaatgggagggtttaatgagccagggcacttctctcccagtggctgttgtgagcagtttgcttgaactgaggaagtcctatctggggcgggaaggggaggagtgaagggagcagggatcactatggaggctgggcagggggtgggggcaccagcagagacaggctacatcgggactctgaagagcagcactctggggtgggcacaggccccacagcagggtcagcctgtggccctgcctctccatcagctcaggtaagcagggccacacccacgccacagtcagcctgcggcagaggcatgggttaaaggggaagccagataaccctgaagcagatagagaccagctggcctttcactcactactcacacctcaccccttcccgggaaccttcagggtctggtttgtgctgacagttggaatttctgcttcctctccctcctctgctctctgatctccaccccattcttgccctttctctgctgataacctatcttgacaacttgcaagcccagagaaagatttgcagggagcaaaccaaggggcaggaggggaagggctgagctgcaatgagcctcagctccacccacatacctacaggtgaggtcgacagccaatgggagtgtctctccttgccctcaaaatgccctctcctggccctccaggtgtcacaatgccggaagtgccacccccggagccacactcctggagcaccctgttagcatgcccaggtgccctcaaggagggtagcccctcccagattgttgggctcctcatactggccactcgtcagctggtaatgtcagccatgtggtggtggcaggggcacaaaagatgcctgagggactccagctctgagggccacaatgctgtccctcctggaggcgtggtcttcctatggtgactgcccacttggttccatccttcccttaccccctcaaaatccgtgtcacataaagcccaccccagcagacctaatttttgttaaagtgccattctgtaagggcaccccctctggccattattccaccacgactaccacgggactcactttcctgtctgtgacaccctggagagggtctttaattccaggcattagtaaaacatccacagagagcaagtgacccgtgctccgccatgaaaccgacaagcagctcagctttctctctagttaacagaagcgtgactacgcccacagaagatctacacagaggttcccgtgcaaattcctgctttgcttttttccttaccaaggaactggtggagattttggtcagctgtggcaaaaccaaggtttctgtttctgaccctatccaattgcagcttctgctggtgtaggctccccagctctgtttctgtctccctggagctctctgcctaccctggcaacacaggtgtggggctttgggagagtaggttcggcatcagtcaactgctccctagtgggatcatgattgcaatgatgtgagagctaatgcccgatgcggcagccccaatccttcctcctttagattggtcactgcaaggaggcatgaagggagctatggggggaatttcgctatgaaagaccatcaaggcatggatgctactttcaggtcagttttctgaatacctaaaagtcctttgatttattttagctagatatttttctttcttttttttttttttttttttgagacggagtctcgctctgtcacccaggctggagtgcagtggcaccatctcagctcactgcaacctccgcctcccaggttcaagcgagtctcctgcctcagcctctcaagtagctggaactacaggcacccactgccatgccaggctaatttttttttttttttttttgtatttttagtagagacggggtttcaccatattggccaggctggtcttgaattcctgaccttgtgatctgcccgcctcagcctcccaaaatgctgggattacaggcgtgagccaccgcgcttggccagctagacatttttctaaaatgctttatgtgctttcttgtcatttttatccaagtatcattttcagacatagatttttagaatttaatgtcaccttagtaaacatctagagttatcaactcatggatgagactactgacgccagagagctatggcaacttgcccaatgtcccaaagtcagcatcagagctagggctggagccccggacagacccctgacacccactctgaggggcatgccaccaaagcagaatgcctcttgcggcagtgaacccctccatggtgcctcgggccgtctctgtgtccacctgctacactcgcctgctgccgtgttgtgatggctcaaagccttctgggttcactccttctccaaatagtctctttgacactgtacatttatcatttctgcctaagctgtctttccactattttttactaaaatttgcctccctcattgaatgtcaactctcatttcttgctgctttccaagagtctacaaacagaaaccacattctagcttttcaattttcatgtccctgggctgggaaactaaccaaataagtgtgttagaattgtgcataaattaaaaaacaaatagtggctgagcaatggccagactgtcaacctaacgaggaggctattaattgccactgcaactgtatccccagcacccagcagagtctctagcacatggtaaactctcaataaatacctattgagtgaatacatgaatgaataaatgaagaaattccaggtgagttaaggacaaggattgggcaattatacttcagctggtccaacatgctaaattgagctgcaaatggtgtagtgtccaggtaccaacatctttttttttttttggcggagtttcactcttgttgcccaggctggagtacagtggggcaatctcggctcactgcagcctccgcctcccgggttcaagcggttctcctgcctcagcctcctgagtggctgggattatagacgtgcaccactgcgcccagctaatttttgtgtttttagtagaggcagggattcaccaccaggctggtcttgaattcctgacctcaggtgatccacctgcctcggcctcccaaagtgctgggattacaggcgtgagccgccacgcccggcccaacatcttaaccccctgtggcatcaccctgagcactttcccaccaccctctgttcacactccctgtgcaggactagtgagggaagggaactaacacatatggagcatttgctgtgtgtgaggcactgtgttcagtgctctacatacgtggtttcattcaatcctcaatcctatgtggaaggtactatgttcgccattttgcagcagaggaccctgagacccgggatattatataacttgcccaaagatcacccagtaagtgaaggagcctaggacgtgccaggcacagattgggtgcttgataaaagtctgatgttatataacttgcccaaagatcacccagtaagtgaaggagcctaggacgtgccaggcacagattgggtgcttgataaaagtctgatgttatataacttgcccaaagatcacccagtaagtgaaggagcctaggacgtgccaggcacagattgggtgcttgataaaagtctgatgaagaatggccagaggtggaattgccacctaggtccagctgtgccaaagctagcatgcttcccgccataccctatggcccaccattgagggagggtattttggacaacaggaagaatgtgggtctcctgatgacccctgaaggttgacagagataaagcagagagattagagaccctacagtaaggggccatgattccagttcaggaatcctccctcccctgtcttagcagacaggcataagctgccagagggaattgtaaatgtcacaggatgctggggagcttgtattctagccaaagcaagcgcatttttttccctgggcaaatcctgctgagtctttcccaccctcaccctgagtcctctgggcagccttatccaaaggtctctgtgtaagcgggagtccaagtgcccgcttctttgaatcccattcagcaggtaaacaggaagcacaaatctcttcctaatggcagccaagatcgtaacccttggtgaaagaccctctgtgttcccattctgctcctagagcaaagcccacccagggagggaggggcccagacctgccatttgcagcacacttcaggacattttcaaaattggctcttgtccttgggcactggagcatacaggtaaaggtaaaaatcctttgaacaaaggaggcaaaactacccagggttaagccttggctctgtgacttcaccaagttgctgtggttctgcaaaccccagtttccccttctctaagagggagctaatgatagcacctgatggggttgttgtgcattttacttttatttattttattattattattatttgaggcagagtctcgctctgttgcccaggctggagtacagtggtgcagtctcagctcactgcaacctctgcctcctgggctcaagcaatctcatgcttcagcctcctgcatagggattacaggggaccatcaccatgcctcacttatttttgtatttttagtagagacggggttttaccatgttagccaggctggtctggaactcctgacctcaactgatctgcccaccttggcctcccaaagtgctggaattacaggcatgagccaccacgcccggcctcttgtgcattttaaatgagatgaggatatcattgagaattatatcctgacgtacagatttaatgcaaaccaagcaaattctcaaaaagagtttactgctgtcattattgttgctgttgctgttagttcataaactaaaatttctataaaagggcaaagaccaaggtatagatatataggaccgaatatgagggaaaaggtggggaaccatccagattcattagagtgctgtagtaatgaagcacatgacatgctgtattgatacagaggtgaacaaattaaccaagataagtaaaggaaatatggaaaaaaacccatgaatccatggcaacatgacacatgacagagtattgtttttaatgagatgaggactccgcagagcactgtgtgctctggcctcattacgccttcatgcctggcaacctctatgctgattgatgtccacgccttgtggctttgctctgctgttccctttgcctagaatgctacctcaaggcttcgtgcagtcccctccctttctcaaggctctgctgaagtgacatcgcctctctcaagggttctccaatccctgcctgcctaatacacccctactctaaccacccctaccctctcctgtcagcctggacacccacccttctgtcctcacatagcaaatcaatccaatgtcagtgactgagaggcaggtaccatgctgggcaacagcaacacaaatagaaccagatagatgtggtccctgccctgccagagcttctgagtgtctggacaagacacacagttcaaaggcaatgctcatattgaggaagtacctatgccagctctgaggcacaggggagggaggccagccctaggcttggggctcagggaagccccctgctgtaggaaagactcagtggaaccctgaggatgaagaggaggagctggtgagtgacatggccagaagccatattcagacagaagggatattgttcatgcccatctttacggcatctggcagactgtagtgtaattatgtgcctacaaatctgtctccttttctaagctgcaagccccagcaggctgataagatatcctgtccacctttgtcaccacagctcgtaccccagtgcctggcataaagtggggaagtgtccaatacatgtttgctgaattgatgaatgcacgatagcaaataatatgtggggaatctgtgcctggctctgtgatgcctgcaagatgcaagaggtcagaggaggctgaggtcacagaaagtgagaaatagcagggaaactaaggctggggctcaacctcaagattggagagatgctttctgcatctagaagtactgactgaaccagccaatccttcagacagggtttctcaaatttggagcaaggttctttgatgattaactgaacaaacaagctctttctagagataaaatgttaggtcctccactcgggttcaaaaatgtaattacatttgtccagaaaaaaaaaaggagattaggcttaaaagcaggttgtatgaaaaaaagaacttgtagttttgaggcaggagaatagtagagggaagtgaaggggcaggtgaacacaaagcaagagaagaagcagaagttgagcagccaaaacaaaagggagataagcaagtaagagaccccatggccggcaagatccagaccagaccagtaaaggtaagcttctcagagatgggcatgtgcactagagagaaaaagtatacttaaaatgaccctgtatggtaattagctatttaaggttcatgcatatggactgcatctcatgcatgtacttaaaattatgggatggaggcaacgcacaagcacacaagggccaaagtaactaagcagtctatcaatcaaaaggcagatgctggctagagattaggcagctcaggaagagaagagaaaaaataaaaggccatgaaatgtaacaaactggtgctgatctcatttcgtagaggtcagtcactctcccactccaagggtgtgatactgtacttcatacactcttgatgctttgctttgctatttctgtcatgtccaattgtttgtggcaccaagaacctggaactgaaccatccagtaacacttttacctgatggcaagctgggcatgaaacacagtgggattttttccaggcacagctcccacagcccagggcagcactgtgggactcacggcactgcaggtccagcacacctagagcacacacctggagcccccaggctcaggacactacaatgaaggaagaggacagtgaggatgaggaaggccaggaaagggactgggatttttccaccagaaaagagaaggctcaatgggtccaggatagtcatgacaagaccctgcacggggccatcatgagaaagcgatgtgcacacaccagagaacaatggcggtcctgtgggcggccggagattttggttctgtgcagaaggaatgtcccgacctgtgattattcatagatggatggtccccatggaggatggtctgccagcgatgggttagggctgagaagactcctgcccaaggagcaaattgggctaaattacctcaaaaagcaaagagcactgggcttggggtcagaaaagtcatatttctcccatcttcaacctgtgtgactctgagccttcattttctcacctttaataatatctgccctgcctgtctccactgggtgctttgagggtcacatgacatggtatctatgaaagcactgtgtaaactgcaaagccctttggaactacaagagctgccgtattatttcctctaaagatccttttgtgaactgcaccctggggcaccggctgggcaggcttagaagcctgccctttctccttgggaggcaccacccctggccttatcctctgaggcgcgctcccctctcccccaaagcagcacacataggcaaccacacacaccctgcagttcaccagccctctgtgagctggaggcagagctctgcttccagaccctggctcaaccacacatccatggttcacaaggtggggaatggggaaactgttcagaggtgcttgcacagagcaaggaggcagtgaaacagcccacctctctggtctctcagctccctccctgcccaggcactagggaagccagtcagggcacagttcacttgggtatacctgaattctagaggaatctcatgcaccaactcaacgcattagcttccaaacacactgccccctcgcaggggctgtttcctctctgtaagtggaagtgctggtgtcctcggagaagccccaaagttcccagcctctagtgcactagaatgcaggctgtagagtgaggcgatcctgaacgctggcttggcctcatgctggcagtgtgacttcagttactcaacttctctgagcctcagtttattcacgtgtaacccggggttaactgtgtttatctgtaggctcatttgtgagaactaaaatagatactacggagaacttgctcaacacagaggtgcacagtaagtgcttttattattatcaccatctcggggatcttgggagtctgttttaaccacgagatcccagggtttttccacagggcaggttttgatggggaaaaactaagggtaagaatatggggtcaaggggcctgcaggtgaattaggaaacgaagaggggaatagtcccagggaagagccgcgggaacgcaggcactcccaagtcgagggagtgcaggccctgggggtgcaggcaccaggaattgcccctcaagtcacaaggtggggttccggctcccctggaagtgggggacgatccctgagtcctggggtttccaggctaggggttgggggagcgtttcctgggtcgtggggtttccaggccccgggtgcgggcgcctcgaccccagggccccgagcctgacgcagcccgccccgccctcaggctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacaggcgaggcggcgtgggagcgggtccccggcctcccttcccgccctcccgcctgccccgccccaagggctacgtgggtgccaggcgctgtgctgagccaggaagggcaacgagacccagccctctcctctaccccagggatctcacacctgggggtagtttaggaccacctgggagcttgacacaaatgcagaatccaggtcccaggaagggctgaggtgggcccgggaataggcattgccgtgactctcgtagagtgactgtccccagtggctctcagacgaagaggcgagaaagacaagtgaatggcaatcctaaatatgccaagaggtgcaatgtggtgtgtgctaccagcccggaaagacactcgcagcccctctacccaggggtgcacagacagcccaccaagtagtgcctagcactttgccagaccctgatatacaaagatgcctgaaccagggtcccgtccctagagcagtggctctccactctagcccccaccctgctctgcgacaataatggccacttagcatttgctagggagccgggacctagtccaagcacccacaagcatgaatttgccaaatcttttcagcaacctcttaaggcaactgctatcatgatcctcactttacacatggagaagcagaagcagagatgatagaatctttcgcccaaggccacatctgtattgggacgggggcagcctggcacccaagtgcccattcctcccttctgaccagcccccacccctccggctctggcgtccaaagggctaaggggaggggtgcccttgtgacagtcacccgccttctcccctgcagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccaggtgggtgcgccccagacacgggtggccgcgaggggccgggccggggctctctgctcttagataagaccacctggctgaccccctggcactgccagaatgtcggtttttttgccctatgcatcgtggcgctttcctctctttgcatgaagcccagcaggtgtaaccagcacgaaaaaatcccattttgcaataaggaagctgaggctcagagaggttaagtaacctgccttttgatagcagcacagagatatagagacccagacccggttaactctagagccgtccctttgctaccacccggtaaacgattcctctggaggggctctgactacagaccttcctaaatagcaccgttcctgaggacctactatgtgctgtgtgggtgctaggaatacactgatgaatatggcatggtcccctgccctgcagtgcgtgctgagcggtagacagatcattgcaatgtgctatgagaagggctctcctcaaccctacctctgcagaagccagaggaaggtatgcctccctctggtggggcatctggagaaggcttcacacaagccgtgctgggagagctaaataaaaatatgtaagtaggcatgagctaggaaaacaaggagaaacgctcttcctagcagagatcatggtggattgactaacagggtgtcctgagattgccactcctgctgtctctgatctggatcagaaatctgccctgtgccccagagagggagggagcttcttggagcccctcagaacccccaggtccatagcactaggctcacactctagtgagatcagactttgtcacagtggccctggctgctgctgtggccacaatggctttcttgcccgtttcttggaactcatcaagtgttttgtgctcagggtgctcagaagaacggactttttactggattgctcctcagtccacccctctcctcactaactccccagcagggttccatggcacagcttcacaccctgctagtctgctgtttgcttcaaaaacagtggtttcctcgagaccccttccacatggcatgggtgggggtgggcgcacaggctgcagactgcggtggagattcatgcctgctctcttgctgtccctcccacagagcatctggacaccccggacaccccaccacggtaagtgagctccccgcctccaccctaccctaccccacccacctagtcctcatcacccagggggtccaggcaggagaaggaataaatggcaaagggctggggctggggtcctactttgaccaggggctgggccttccttgcagcccaccaaggcacccctcttgcagcctgccaaggtcttccctggacagaccaagcctcgctgacctgctcctcccccacgactccaggctgtgtttcttcctgtagtttcccctccacattcttgaacaggcagattcatacaaaaaccacattggggacactcatccccgttcccccctggcactctgctgaaggctttgcaaacaaaatctctagaggttctgagagcctaggtgaggggcccagagacccctaggaaatcactgactcctgggtcatactctcctcttctgtggcatccacccatgtgaaggctggtgttgaaggagaaagaactcaattcatagaccctgtacaggctgggcctgatcctggcagagggtaggagtgggaggaggagcctaggcactcccataactccacccacctgtgccctgaaggctggaggtgccacactgctggtggccccactcatcagctgcctgccgatctctccacagtcccacaacctgtcctgtgtccctgtttgctgatttactgtcgcaccaacgcccctgaatctgaaagccgaccgttgttcagtcatttaacaaatacttattgagtacctactgcataccaggcactggtactaaagacacagcaagatccctgacctcacagaactcatatcctattgtggagaattttaataaatatggaaacacgccacctgacatcgtaaagtaagagctgtgaaggaaatggacacgtgatgcagcagattccctggggagggggcccgctgctgggctgaggctgctttagatcaagttctcttggaggacatgacattgaggggacctgaggatggaggctggggcctgggcaggtaggagcggtggagttccagagagcaagccccactagagtgtggacgtaagacagggacagtaggggcagcccgggagaggaaaaggcaagtagaaagactcaggtgaggcccagaaaggaggcaggcatttctggagggtggacgggaggaaggcaggaaaggcgtgggggttattgtgggtgcaatgggaagtcactgaatggttttaagcggacgcatggctccatcagaacaagctggcccaggagacttggttgcaggccgttggcaaggctgaggctggcttggctgtttggacaaaggtgcaggggtggcggtggggaagtgggtagacgggaggcagggcttgcccaagagcccagtgggcagcacacagtgtgagagggagccaggctgccggggttgggagcctgagccctgggtcccacttcctgagataaagacaagaggagaagagagtggggcgggtgtgagggtcatgcgtagcacagtggacattgagatttgagattcccactgagatgtcctaggggaagtcaggaaagcagttggggaccaggaggccaggccggagattccgatttgtaggtcagggacatggagccagtcttgaggcctcagacagagatagcaactctatggtctgggctgccctggcctttgggggcccctccctattcctgactctgcccagcctccgatgccattcatctctgagccctgccggttccagccgcactgctccccagaatgtctcctcttcttggcccactgctggcatatagtttgggcagttgtggacctcccacctgtttggatgatcattcaactttctcctgtccacaggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtttacagggcctggaggcccagtcttgtcctcctctgtcaccgacttgctgtgtggacctgggacactctcttcacttctctgggtctcaattcatttactgttgaacacggacaatcatattcttccctcctggctgggaggactacaaagatctgaggaaataatggatatgaaggggctttggaaagtacaaagccatcttctcatgaggggcatgacagaaccctctttgcagagtgacctttggacgtgcagtcagttcttggagaagtgtggcccctgcagcagtgtcacggagaacacagagttccagagagcaagcctggggcaggggctgtgcaaacgtgtggtcagaggaacatcaaatcctggaaacttggtggcagggagaggcctggggcctttaccccatgccccctgggatctccactgtgactgtcccacaccctctgcccaactcttgccccatcagctgccctgcattgccttgagctgggacccctaggaaatggaaaccaggctcccctctctcaaggtatctgggaaccactgtctcaggagctgaagccgggagacctgaggggaggtctggccggagagtccgtgcgtaaagcagctacagctctgacctctctgacctgcagcctctcagggcgtgcgaagtccaaacgcactggcaacttcaccccctttgccctaacgcgggcaggctgacttggaggggtgcttccctatttacacctcagggtgaatttgttgatcaccttagctcctgtggtccttggggcttagggagaggagggaggcatgcctgggtcccaggtaagctggcaagaggaaagggccacaggctaggggaataacgaggccatgaacaagacatctcaccccagttacaatggcttttatccaaaagacaggcaatgacaaatgctgatgagaaagtggagaaagaggaatccccatatactattggtgggaatgtaaattagtatagccactatggagaacagtacagtttcctcaaaaaactaaaaataggctgggcgtggtggctcatgcctgtaatcccagcaccctgggaggccgaggcaggtggatcacttgaggtcaggagttcgagaccagcctagctaacatggtaaaactctgtctctactaaaaatacaaaaattagctgggcgtgctggcacgtgcctatagtcccagcaacttgggaggctgaggcagaagtattgcttgaacccaggaggcagaggttgcagtgagctgagatcaccccactgtcctccagcctgggcaacagagagactgtctccaaagaaaaaaaaagaaatagaactaccatatgatccagtaatcccactgctgggtatctgtcagcaaggaaatcagtatattgaaaagataccagtactcccatgtttactgcagcactatttgcaatagccaagatatggaatcagcctaagtgtccatccacgaatgaatgaagaaaatgaacacacaatgaaatattcagccataaaaaaaaaaaatgaaatcctgtcgcttgcaacaacatggatggaactggcagccattatgttaagggaaataagtcaagcacagaaagataaatatcgcatgttcgcactcacatgtggaagctaaaaaaagttgaaattgaactcatggagtaatagaataatggttaccaggggctgggaaggatagcagggagcgggcgataacgtggggatacttactgagaacaaaatactgttagaacgaataagatctagtatttgctagcacaagagggcgactatagttaacaacttattgtatattttaaaataactaagagtggaattggaatgttcttaacggtaagtacttgaggtgatggatacgccaatccctgatttgatcattgcacattgtatgcctgaatcaaaacatcacatgtaccctataaatatataaatacatatacccatactaattaaaaatgttttttaaaaaagaggcagtgatgctttttccagggagacggtctgaaggtcaagggatcttcacaagatcttcacaagttattatgcaggccagtgggttgcaaagctccactcctcaccagagccttcaccagggcaagaggtggctcctaattaaccttgggattcatccaggagcctgtctgagctgttaagaggtcacaggagcaggcttgtgtacctccttgtatggggatgctttggggcacctctatggaaagtcctgcatgaccagggaagaagttaaggacacaggagtggtgtgtattggaacatctgcctggtctttgaggccagtttcacagccaagaaaaattgcaataggaattatttcttaagtatctgctttgtgctctatcacctcaataccattaccacatttgagatcattaacatgaatgcagtatcattttacagtccgtattcagatttccacgactgtcttcaaaatgtccttttgaagtttgttgtttctaagcaggaagcagttgactccaggtgattcttaagctaacggttgagactgcagctctgggtgcacctggcattggcatgatggtgcagatgtgtaacggtgccaggtaatcagctggtgctagctgatacatacccttctgcggtacttgcattttgaagagggcttcttgggactggaagaagcgccattcctcagagagacatgcctctgttggcatggtttcagatgcagtgagaggctgtgggaagcatgttgaggagggtcggccagctggcaccccctttaacaacggcacacagtgcacaggcagcccccagcttggcctcctgataaagccgctgctcctagggtcagaggggagggtggtgaggggacagcactcggccctccccagaccctctgggctgctcttggagcctggcactgtccctgtaagaggtctgggtggagcagagctgcctgtcttcccccacccaccctctcagagtactcaggctctgtcactggcaacaaagaccagagacacgagcggcaggctgagtcagcatggtgtcctgcggcacggagtcaaggagagaaatgacccagaagactcggtgttttcaagattggacttcctgttgtagtgcagggcacagcgttccatgaacatgctcttcccaggggcttctgacaggcaggctgcggcctgcaggctttgctctgtggtcaatgcccaccagactttgaagacagcagtgagaggaagtggccggcaactacctgggtgatctcctgggtccaccaggagcccaacacactttccctgctgccaactgaaatttaaaactagatgtagctacgtgagaagaaaccacccaggggataatctatggtgaaagtaggccctgccttgagatggaaatgagttggctggagacaccatgggctgagttttcacttgtacctcactggtcagacaggacaagagagccagggtcagggtgggtgcttggtcccccaccagtcacagaagcctcaggctggaaggctctttagacaagagtcaagcgtccgggttttgtcccggctccagtgctggccactaaagtccagtcccaccccctcttcaataacagcccctcatgtttctgggccccctgtgatcctcaaagccctgtaagatcccagtggaggtcaggggcggtggctcatacctgtatcactttgggaggccgaggtgggcggatcacctgaagtcaggagttcaagaccagcctggccaacaaggcgaaaccccgcctctactagaaatacaaaaactagccaggcatggtggcaggtgcctgtaatcccagctactcgggagggtgaggcacaaaaattgcttgaacccaggaggtgaaggttgcagtgggccgagatcgcgccactgcactccagcctaggcaacaagagcaaaactccctctcaaaaaaaaaaaaaaaaaaaaaaaaaagatctcgggggttctaagagcccagcaggtaagactggaattatactcattttaaaatgaggaaaagcccccagggaggaaagagatcttgttaccagaaaggggtcccgatccagacactaagacagggttcttggacctcgagcaagaaagaattcagggtgagtccacagtgcaaagcaaaatcaagtttaagaaagtaaaagagtaagaaaatggctactccataggcagagcagccccgagggctgctggttgcccttttttttggttatttcttgattatatgctaaacaaggggtggcaaagaaagaccaagagagaaaagggctgtcttcagaagagaagcattttcggagaaagatcgtttctttcagagggtccccacaaagatgcccactggtctggagacagctaacttggctgctgcactagaaggaagtgagacaacctgcctctaggccactttccaacccttcaatcttgtggttccatctggtttaaaaagctgccaagcttagacaagggtgagggagacataccccactcccagaaaggcctgtccctaaggaatcccaaattggtttaattctcaaatggaatgtgcagacccttctccacaccttggcccattcaaagtgcatcttacaaatgtgagtgaaaaataacactaaagagaactccctgggcatcccaccactgaaggtggatttccccagcagaccatgaccaagctggggttacactgccagaagcacccccactcccacctcatttgtgcaatttttatggccctgctcttaccaagctcaaggccacatcacagaccctcctgacctctctgagatcagcaggtggcctcctgtccctgccaattctgaaattctcaagttaaaacttctctttgaaattagaggcctcgcccatcgtggtgaaaggtcacaaaataactattctatccattacgaagtttctcatataaaatttttcttattgtggtttaatgtatgaaaagactgtcaaccaacttgcaggaaacaatgagacaggcccgccatgtgtaaattaaattcgaatctagtttatttgcagaattttacttaaccagttgtcatttcttcctgtttctcaccattatataaaaacttaccctttgtacaagtatgaaaaatgtggaacaatgaataagtagtgaatattgcacatttaatgtccaaaataaagttgtggtttttaaaggtcacactagatatgtgggaagaaaacgagttgaacacacttaagtatgtgtctccacataagtgattttaaactattgaaagaaaaataaattctatcagtgctcaatgagagacagtacatctgtacattaaaaaataaaagttataatcaacaacattccttcgcaatttcattatcccaaaagaggatcagtagtataattatttttttttcaagttattttcatcaggaatcaggaacctaccagagtgaaggaaacctcaaatacagctactcctggacactgatgcccgaggcatgctgtggaaaccggaccaaaatgaagtctgcgttagtaagtctagaactttacccagcacaacccagacacaaatggaagatggtagaaggggatactttcttttaatcaacacacttatttcccaacattatattctccattttgcttaataagacaaagttaactgatcagaaaaatgatcagctactatctcaaaatgagctgtacagttggcccaaaatgaagagcaggcagtagtagaggattaagggcaaagtgccttgttgttaggcctgtcatgaagatgtggggtgagatctgtcttgggcaacaactgatattaagctgaggtctgcagtctcaacttgccactagcttaatgtgcctcccatggggcacagctactgaaagctgatgctgcccaagcatttagggagataattatgccacttggaccacactggtgcgactctaaccccagggctggggccagaatgaggtaaaggaggcaccacgggggtaaacccaaggaagcactctcttggcacctgcaagcaagcaccaacttaaatgtatgccccaggtgcctcatttgtctcaccctagccctggccctgctaatccggggcacaccccttttaggataacacggactaatttggacactttccccaaaccgtagcccagttagacatgatggtggaaaaggtctaactaaagacattgcaggggagatgggcgcggtggctcacgcctgtaatcccagcactctgggaggccggggcgggcggaccacaaggtcaggagtttgaaaccagcttgtctcaatggctgggtgaaaccctgtctctactaaaaaatacaaaaattagccgggcgtggtggcatgcacctgtagtcctggctccttgggaggctgaggcagaatagcttgaacccaggaggcggaggttgcagtgagccgagaccatgccattgcactccagcctgggtgacagatgagactcgtctcaaaaaaaaaaaaaaaaaaaagacattgggggatttagcttggatttagcctaagaggtgaggggtggggtggaagtggtgttagacatgtgatgaaaactgaaaatatctaaaggtctgcctcaaggaggggcaagtgaacagccccagcctgaactgctctggacagaaccacgaccaataggcaacgtagaaacatcttggttcaatagaaagcagaactacagagcctgcggatggcagcctaggcctgcccatcacaggctggaccaccaggcactggacaggggcagaggagaggcaggaggatccctgcagagtgagaggggcactagatgaacgtgaatgacccttctgactgtaaaagtctacgattccaggacatttgcttcctgctccagaagaaagaatttcaggaataaaaactcagtgaaaaagtatatatcaccttcatttgaaaggaacgaggacatgaacactcttggcttgtatgacatgtacacactgattttgatgatgaactgagaggaaccaggaggccgtcacttggttgaaaggaagttaggctggtctatgggttttcattttctggactaggctttccccaacctcaaagaagtgagagacgcaggcacacaaccccagtggggcagaggcatgcgatgtctgagccaacaaaggatggtgagactgagaaatgagtcacgccttggagctgaggtcccgagtgtgcaggaaggagctttggaaacatgtacaggtgggtcccgaatccactgctactgtcatgctatgtagacagttgtgtagacacatctggcaggacctccctccctctatgtctggtgtgttccagcattctgcccttcacttgttctattaataggcagtgggacaacatgattccgggatgcagcctgcctctgcaacccacctgtgcactgcagcatggggagtgatggagagggagagagatgtttttcatggcaaccagaatcctgcctcctcctgctcccaggaagctgttagacatctttatttggtcccgatgccactgttggccaccctgtggtgaagtctggagcctgcagccgttcgccctccacgctgctcagtccacagggccttggtcttgcttgattcccgtcttgatgtgcggcacccatcactgattctgaaaccacagccccgtgctctctggaggccaacaattttttcaagccaaggctcattacccctgcaagccaacaggcgggctggtctctctgccgcccttctttcccaggaggctacagcagcatggccatgtctgaactagctcagtgtctttatagcacgttcctagcccagagtttcccatagacacctaggagttgagtcaaccttccaaggttaagcaagaaagagttaaagaggaagcgctttcactgaccatctctgattattaatgaagttcaatgtcaaataaattaaatgacatcaggcataaaaacctacagcaactttaacagctgaaacactttacaagatagtgtgatatccctataatttggtttttaaacagttacaaccaaagataaatgattttattttttataatttttacagaccaaaaaacattatacagattaatcataattttctttaaaatgtgcatactgtcactcaaaaatttcacatcctaggatatcagtaattatatcctcctcaaagaaaacacaaaatatttccaaacaaaaatcgctgttgccagatcagactattaaattgtccacagcttctcaaattttcttatacagagaacaagatgattaattttgaaaacggagagaagcaaaaataagaaaagctgagacagatccctctgagacggacattttgtggcctgtaaaactcaagagactaaacagggatgttctttatcagagctgcaaagcgtgtctttaaggcagaatcgttctgtccaagtaaagaaattcaaagtaaagaaaagctcctaccaacttcccaattttgggggaagcattccaaaaggacatttgaggagagattagcactctgttaactatattcctatacccctataaacattcttggtggctgtttagacatttttaggtaaatattctcaggctacagactacccatacacaaagacatattaagccagctatgcaggcaaaatccatctagagctgatagaatgaggaacgtgggaacagaagtcaaactgctcattcccaggagaaataacatgagcaagaagatggccacagaacaaggcaaagttacacacaggctttggtaatgaatgaactgtcaacaacagaaggcacgtggctatggaaaaaaagccaaatttcagtagatctcccgacctgacccagtttccacagacaagtgtttcagcaggtccattggcttcatctgagtttgaagttaaaaaacaagcagggaacagagaatcaggtcttcagtctccctcagtctctgtctcctgacactgagcctttcagatatcgaacatggtgtctatcaaagggtgcaaacttaggtgtcgacaggggcaagtgatgtgaatgaggctagggtcagggcccgagggaatgcacagactctcccgactagagagaggcagccctgtctgcactcctcaccaagtggaccaaacaaaacatctgtgcaaaacatgctcctcccagactgccagcttgccatcctgattcagacaggcagcttctccatgaggatacacggctggatggaaattgacttgtcatcatctctactgcccactataatcacgatcaagtggtcgtattttacacatgacccactttaactaactcggcatttttatctcccttctgagaaaaacaatactttaaaactattgtatttgtccacatttgagaaatgcagaaatttttcaaaattgacttctttactttggaggaacacaaatggggtttaaaagtaagggtactgagtgacttccaaggttgtcagatctggaacatttacataaaacagagacagaagtggaaacatacaaagaactccatctggaggtcttgtgagatgactgggacattcggcaactgtgagtggctctgcacccaagtggaacttagtaagtttctcttgtggataaatataaaaacttaaagagtccccagaaggtcttaagagctaagaaaacacacacacacacacacacacaccccaaaattatctaatatctaacgcctcccaacttgcatctcagtcaactacacattggccaaactgagctctacagtgcaattgagcaaagttacttgtgcaacagcaaagttaaatgtaaacataaacagcaatgggtttttcaagagcctcagtgttaactatcgtatgtggtccaaataatgcacttctggatacagacagttaacgagaagagccaagaagcttttcccatcttgaaggcaatggcc

SEQ ID NO: 354 - DNA, 177938 bp, Homo sapiens
tggcacgatctcagctcactgcaacctccacctcccgggtttaagcgatgctcctgcctcagcctcctgagtagttgggattacaggtgcatgccactcgcccggctaatttttgtatttttagtagagacagggtttcaccatgttggccaggctggtctcgaactcctgaccttgtgattcacctgcctcagcctcccaaatcatatggtaattctattactatttttttgaggaaccaccatactgtttttcatagtgatataccattttacattctcaccaaccgagcacagggattccaatgtctccgcatcctcaccaacacttattattaatattttccattttttttgatagtagccatcctaatgggcataaaatgatacctcattattgttttgatttgtagttccccaatgattactgaggttggacatcttttcattgcttattggtcaattgtatattgtattgtattctttgaagaaatgtctattcaagtcctttgctcatttttgaattgcattgtttgtttttgttgttgttattaggggttttctaaatgttctggatagtaatcccttatcagatatatgatttgcaaatattttctcccattctgtgggttggctgtttactctgatattatcttttgatgcacaatttaaaaaatgtgtatatagtccaattttgtcatgaagattttgccctatgctttcttttacgagttttatagtttcagatcttacatgtaggtctttggtccctaatgagttaatttttgtatatggtgtttggtaagggttcaacttattcttttctctatggatatctagtttttcggcatcatttgatgaaaagacggtcttttctcctaataaatggtcaaaataaaaaccatttaactggccgggcgtggtggttcatgcctgtaatcccagcactttgggaggctgaggcaggtggatcaccttgaggtcaggaatttgagaccaatctggccaacatggtgaaaccccatctctactaaaaatacaaaaattagctgggcatggtggtgagtgcctgtaatcccagctactcgggaggctgaggcaggagaatagcttgaacctgggaggcagaggttgcagtgagccaagatcatgccactgcactccagcctggtgacagagcaaaactccatctcggggggaaaaaaaacaaccatttgaccatatgtgtgagggtttatttctgggttctctattctataacattggtctatctatctgtctctatgatagcaccacactgttttgattactgtagctttgttcaactatgtattttaaagcaaatttcggacaccatgtcatatcacccctacatatttcaaagcacatctcttaaaaatatgcatgtgctctcatctaaccacaatttgacacatgctttatctctccaccttttttttttttacttcgtgaaagtattttaaatataattctttttctttttctttttttttttgagacggagtcagcctcttttgcccaggctagagtgcagcggcacgatctcggctcaaatgcaacctccgccttccaggttcaagcaattattctgcttcagcctcccaagtagctgggattaccatgcctggttaatttttgtattttcagtagagacggggttttgccatgttgaccaggctagccttgaactcctgacctcaagtgatctgcctgccttggcctctcaaagtgctaagattacaggcatgagccactgtgcccagccttttaaagagaattctttaagcacaattatcaaaatgtaattttttatggcacaggatccctgcatacaaatgtaacttttaaattaacatatttggttgatgaattaaatgaaaggatggccaacacaggaagctaacagatagtggaataacaagtactgattttaaaaaataaataaataataaaacagcaaactaagaatcttttctactagactaagatatcactgacatgtcagagtaaaaaaagttatggacacgagaaacatcagaatgtactgtaccttagaatgaaatctcacagaaaagaactctgtctaaaaacaaacgactcaggctggacacggtggctcaggcctataatcacagcactttgggatgcaaaggcgggtggattgcctgagaccaggacttcaagaccagcctggggagcatggcagaacctcatctctacacaacatattaatacaaaaattagctgggtgtggtagtatatgcctgtagtcccagccatttgggaggctaaggtaggaggatcccttgaacctgggaggtcaaggctgcagtgagctgtgatcatgccactacactccagcctgggtgacagagcaaggcctgtctcaagaaaaggaaggagggaacgaaggaaggaaggaaggaaggaaggaaggaaggaaggaaggaaggggaggggaggggaggggaggggaggggaggggggaggggagggggggagggggaaaaaaaaccaaatgactcaaaacagagatatcaagttgagacagagtaaagaaaagaggaaacagtggtgagcaatagacctttcaaaacacatagtgaaatctaacaggctaatacactgtataaaattgtgtagtataagcacacagtaagaatttatagctagaagaaagaatacaagagaaattcaaataatcagctgaaatgaagagtattaacttatctctgcaaaatttaggagttatgccacacgtgatggctcacgcctgtaatcctagcactttgggaggtcgaggcaggcggattgcttgagcccaagagtttgagaccagcctgggcaatatggtgaaaccccatctttacaaaagatacaaaaattagccggatgtggtggtgcatgcctgcagtcccagtaacagggaagctgaagcgggaggatcacccgagcctgggaggttgaggactatttgccgagattccaatatggatttgccttattgtaacagagacagatagatcagtggaagaaccaatcataaatataaattccagaagcataaaacacttaaatgtaaaatattaaatgataaaaatcaagaatgaagtatcggaccacacatacaacctagggatggagaaattatctaaaagaaaacaggaaacccacttgctctgcagatccagatagttaactaagcatttataaaagctttttatgtattatggatattcaaatctttatctgtattgcaaatattttttcccaaatttatttgtgtgtagactttaattatctcttgccaagaaatagcaataggcaaataaatttgggaaagaaatatttgcaatacagattaagagttaaatacccataatacacaaaaaataactctcacaaaacaaaagataacctaaaagacaaatggcagatgacctgtgcagcaaatcaccatggcacatgtttacctgtgtaacaaatctgcacatcatgcacatgtaccccgaacttaaaataaaagttgaagaaaaaaaagaaaaagaaaaatgataaagaatatgaatagaaaatccatagaagggcaaatcgaaatggctgagaaatagaaaagaactacttgaacacattcgcgatcaaggaaacacaacttcaaggaaataccacttaaggtaccatgaaatgtatttattagactgacaaaatttaaaacgtaacagcattattgacagagatgaaggagtgcggaatcgggtaaggtactttcatactttctggtggaaatgtaaattattatagttttttggaaggcaatctggtaacgacatcccttaaaatttaaaatacccggcctggcgtggtggctcacccctataatcccagcactttgggaggccgaggcgggcagatcacctgaggtcaggagttcaagaccagcctggccaacatggtgaaaccctgtctctattaaatacacaaaaatcagctgggcgcggtggtgtgtgcctgtaatcccagctactcgggaggctgaggcaggagaattgcttgagtcagggaggcggaggttgcagtgagccaagattgcgccattgcactccaacctgggcgacagagcaagattccgtctcaaaaaaaaaaaaaaaaaaaaaaggaaaatgaaaaatacccgtactatttagcccagcaatactactcctgggaatgtattttatcatttgtttaaacctagataaaacaatgtttgttatagctatatgtgacggctaaaaactaggaatatgagtatctctcaactttgaataagctacggtggatctacagcaaggaatacgtgaaatcatcaggaaaattaattagagtgggaccagctaaattgtagggatttccacaagatattgctcagtaaacaatgcaagatgcagaaaagtgtgtatgagagcaatgacaaaacatgaaggaatatatgtgtggtgtatatgtgtgcgtacatgtagaatagctagctagctagatgttgacagggttatgagcatagagaaatgtgtgaatgataccaagcccattgctcacatggagcaaggcaggaggatgggcagaaggagagggggatggcagaggagaagcaaacagaagagatgaaaaaaaactgcactaaaaaggagtccatgtgcataagatcttggttatgttaaattgtatcttgatgcataaaatatgaaatctgtatcttcccattggcagaaatgcccccaccatattgtcaagtgaaaaaagcaagtggcagtgtagtatgcttctatttataagtgatacgaattgggattttgaggctcacagtgcctcaaaggggttggaaggttggagcggcaatggaggaagagtcttcttgtcgttctgctgggggatgtgtctggagacaacactggtccagttaaggcaagggctgccttggtatgtgtgtaggttggggtaggtgtgggggtggtcattgtagacttcggggtacagctcaaagcagatgcctaaatcccactatctgagtcattccttcagtctgaacctgtggttccaagtctggttttatttttcccaaggatggaaggttctggaagactttgtctactaaatcatgtcatttgttaggcaaaacctctcccatcctggacaaaaggtggcaatacatatgaggtggcttcaacactctcatatttatactgagatatatttggctgcaaatgttattttaacgtcaagcacaatctgaggaagtacaagttttcatattagttttagagaagcacagagggtttcctatttcttaacttgtgatacagattgagtatcctttatttaaaatgcgtgggaccagaagtgttttggattttggatttttttttcagattttggaatatttgcattgtacttactggctgagcatccctaatctgaaaatctgaaatcccaaatctgatatgcttggtctcaatggtctctcgtgctcatgctttgagcatgtcatcagtgctcaaaatgtttcagacttcggagcatttcaggttttgaatttttggattagggatactcaacctgtatcagcaaatacaggcatgtgttgactaacaacagggatacgttttgagaaatgtgttgttagacgattttgttgagtgaacatcatagtgttcttacacaaacctagatagtataccctattacacacctaggctacagacctacacagcatgttactgtaatgaatactgccggccaggggtccccaacccctgggccgcagactggtaccagcccatggcctgttaggactgggccacataacaggaggtgagtggcaggcgagggagggagcattactgcctgagctccgccccctgtcagatcagcagtacattagagcatagagtacataggagcatgaaccctattgtgaactgcgtgtgcgagggatctaggctgtggctccttatgagaatctgactaatgtctgatgatctgaggtggagcagtttcatcctgaaaccatccatcctcccaccccgcaaatccatggaaaaaattgtcttccacgaaaccggtccctggtgccaaaaaggttgggtaccgctgctgtaggcaattgtaacacaacgggaagtatgtgtttatttatttatttttttaggacagggtctttctttgtcacccaggctggactgtagcggcgggatcttggctcaatgcagcctcaacctcccagactcaggtgatcctcccacctcagcctcccgaatagctgggaccacaggcatgcaccaccatgcccagctactttttcaattttttgtagagatcagttgttttttgcttttcctgacttatcacagacttttgtaaaatatttttaaaaataaaccatggaattaaagataatgttgggcatggttgctcatgtctgtaatctcagcactttgggaggctgaagtggacagatcgcttgggctaaggagttcaagaccagcctgggcaacatggagaaaccctatctctacccaaaaaaaaaaaaaaaaaaaaaaaaaaaaaaaagtagccaggcatggtggcatgtgcctgtaatcccagctaccagggagactgaggtgagaggatcacgagagcccaggtcaaggctgcagtgagctgagattgcgccactgcactccagcctaggcaatggaataagaacctatctcaaaaaaaaaaaaaaaaaaaaaaaaaagcaaaaaataagcccaggtattttagtattacagtcagcacacataaaatgactgtcaaattgcttagaaacttttataaagttgctaagactcaatttctgaacatatattatggcagtctttaacagtccaagaccacactttggaacaccagtgttataaaaaggacatatcaggattttggtttgacatttaatctgacaatcatttaactaatgagtttggttcatttattgttattggtatatttaggcctgtttctagaactcacatctatatgtcctctttccaacaccacagtgatagggcctccaattacactgtaatattatggatatttcttttttctttcctgtggtcctggcttatttccagtgaccaggcttaccaaatatttcttgctcatcttcccttcagttatctcctacagcacttcctaggtttgttgaagtattttacccaaaaatattaaaatgtgggcattcaagtggctagacataacattctaagttcaaagttcttttccttcagttcttaaaaaatgctgctgaaaaatccaaggcttattggatcagagctcttgaggttttgattctgttcattctctctggaagctttcagaatgttgtcttcgttcatcttaaattttactacccagtaatgaaaatgaaatgcactacattaaagagatgtatcaacataaaagtatctcataacactgaataaagcatgacaacatgtatctcattccttttacatcatgttcaaaaccatgcaaaacttaatagattacttgggggtgctgttatgtggcaaaattgtgaaggcaaggacaggataaattcaaaatttagggtagcagctctcttgatggggatgaagatgcagtaggagaagggtcccgaggggtggggtgtctgaagcactgtttgtttgtttgtttgttttgagaaggagtctcgatctgtagcccaggctggagtgcagtggcacgatctcggctcactgcaagctctgcctcctgggttcacgccattctcctgcctcagcctcccgagtagctgggactacaggcgcccgccaccacgcccggctaattttttgtatttttagtagagatggtgtttcaccgtgttagccaggatggtctcgatctcctgacctcgtgatgcacccgcctcggcctcccaaagtgctcggattacaggcgttgagccaccgcgcctggcctgaagcactgttaatatgctgtggtcggagccgggggtggaaacatgggtactccttactttttaaataccttacaaaatcttttgcatgtacctaacttcaggtaaaataatcccccttgtgatgaactcgccagcagcggttcataggtcaggatattgggaatggtggcagctggctgcaggtcttacaggagcggctgcagtggacagtcatagctcaatgggccagagaagaaccacgggttgagatgggaatggggtagttctaggtttgccctaaacctggggtgtccaatcttttggcttccctaggccacactggaatactgtcttgggcctcacatgaaatacactaacatcagctgatgagccaaaaaaaaaaaaaaaatcggccaggcttgttagcttacgcctgtaatcccagcactttgggaggctgaggcgggtgaatcacctgaggtcaggagtttgaaaccagcctgaccaacacggtgaaactccatctctactaaatacaaaaaattagccgggcatggtggtgcatgcctgtaatcccacctacttgggaggctgaggcaggagaattgcttgaacctgggaggcggagattgcagtgagacaagattgtgcaattgcactccagcctgggcaacaagagcaaaactccgtctcaagaaaaaaaaaaaatcacaaaaaatctcaatgttttaagaaagtttaagaatttgtgttgggcagctttcaaagccatcctgggtcgcatgtggcctgtgggccgtgggttggacaagcttgccctaagtgaaaaaacacatctaatcacctctggacccatcattataccccaccagggagccacgctgaggacagaatggagctgctctcagtcccccacagctcagcatttcctgacccagtctgaatactcagcctgaaagtgggcatggctggtgagaccctctctggtcaccactcccaaaatgtcttccacctccagatgtgttactgtaataacagactcagaatttcaccccctaagtccaacatgggtgcactctctaactttttgaggcctctgagactttacttcctccttccacatcctcgcaagagtcctgcccaatctctggttctctgggaacgaggactgattgtccctttcctgtagctttcattgatcagtctgccaggcacctgacaatgataacgctcatgaacttgttgaattgaatttcttatccgttgatttcctcccctaggtgacaacttttaattaattaccatcggctttctgtacctgaggcttctgtatccttggattcaaccgaggattgaaaataaaaaacaataaaaacaacacaataaaaatgcaaatatagaaacaatacagtgtaacaagtattacatagcctttatattgtatttgatattataagtcctctagagatgatttaaagaatacaggaagatatgcatagattatatccaaatctatacactacaccatatccatgtacacatacactacaccaaaatccacaacaccattttatgtttttgagacagtcttactctgtcacctcgcctggggtccagtggtgcgaacacggctcaccgcagtcttgaactcctgggctcaagcaatcctcccacctcagcctcctaagtagctgggaccacaggcgttcaccaccatgtgtgcctaattttttttagtgaaggggcggggcggggggggcgggtttcactatgttgcctaggctggtctcgaactcctggcctcaagcaattctcccgccttggcctctcaaagtgctgagattacatgggtgagccgctgtgcctgacccactatgccattttatatcagggacttgagtagtctcggattttggtatccgaggaggtcttggaaccaatcccctacagattctgagggatgactcttttcttaaagagtagcccaagaaggaggcacgtgaagagcaaaactgtgtccaggagagcttttatttgtacggaacagttttaaaaatacagaataaaatagctttatctctactattattcacaacatctggtccaaatattacatatttttaaaatacttaaacgtttaatgaagccatgttagaaaaacaatatgaaaattctttttaaaaactccataaaagaattacacatctcaaaaaacaaccccaccccaaataccctcggtaatcaaaataaaaataaaaaacaaacaaaaccccagaaaggtatatatagccaaagtcagtcacaaaaactcaaggaaaatataggcatccccactgttttaagaacagtcagaaatgtattaaggtgtcaaatgaagattgttactaacgaacaaaaaaggagagtcatttgaactgtcagtaagatggcaacgtggggaagggtgtcctaagtgcctggaaacacgcacagcaatgctaaggacatgggagggtagagtgatgctgaaacacagtcaacaccaaccagaaaggacgggaatgtctgtgaggctgctgaaaagagacccccaacgctaatgtgccttatgggtccatgggcagacgctgaacgctggcaaaaccgggtggccgttcttgcactactcgggttctgactgcaggaggggcagagggtggtcgatgtcctagtccctgtgtctaaaaagtcatgaggggacagagtacaacaggcagcacgttaagtccctgggctcttttccaaagccaagaggaggctccctggagaagcgagctttgcgaatgctcaggcccggagccgcacactaacgcggcgtgcagcaggtgtggctgggtgtgcacagctggcgtccagcgacagccatgccgggcctatgcctatagcgagtgtacaccccatgcacggccatcccccaggatgctgctgcttctctggccagatgggttctggaatgaggcttctgctactgctccatattcaccttcaatctggcctggccactcccatggcatccgtattactgaagatgagacttgccaactttaagttgctagtaccaatatttcagcagggatatgaatgaaagaaataacaacttagctcatggtcataaaatatacgtatgggtaaataaagtatacacacatactagagattcatcaatggagaaattctatcatcacatgacattgtcatgaaaattatatcattccctccctggaaaactgtgactattatcctgggtagaaatgttattttgctatatggaaatactgcaatattcatgcataaaccaagttgtcatcatgaaagtcggtattctacagcataaagcaaaacctctgtgcgaatttgttaccatgaaaacgggaaaccatcaggacccatgatgcttcattctggctggcatggttaaagccacttctcttgccttgatcaatcccaagaaactaaaagttagcatttgaaatcctcttgaggattctgaaagtaaatgtatctgtgaatctacatttaacttcctaatgagaatgaaaattgcttacaaagactagagtcacttcccattattctgtgaagcaggggtgggggccctccatcccccactgtgaatatggcatcacctcctgtccgtattcacgctgtctacatttcatgttgggattgcccacacaaatgctttctttcagggaccaggcaggtgacctgggaaggtggtgggtaggtggtctctgtggaaactggagactaaccggcctgcaaggacattcacatccaaaatattttacaacactctacaggcaaaacaaagtacggggtggtggttcaaagccccagcaacgcaggccaatgatgtgaatgggaagtgtcatgacacagaccgcgagtggccaccgtgtcccccaatatctccccttcaggtgtgtgcttaaacccaagaagcagatgaatacattctttttctttcaattacaaactttcattctgtagcatattttccagtaggagaaccacttcctaaaatggtgtgtgtgtgtgtgtgtgtgtgtgttacatgttcaagtttattagtcattaggggactccaatcactcaaggctgtgcagaaagtaccagattcagcaggggcatctagtcaggctgccctctttgctccccacctcctattcccttacccctcctcggacagaattattgggttggccacagtggaatcagaacaggaaactctcactccaacaggagttgaaagggtagggcttccttccctgtgtgaaggcctacagagggcaccccacatgttagcggggttgaatcctcctgatacaacccggcccaaggaggggcttcagaagggagtgggtttctggatgactagagcagacaccttgagtgttatgcagcggaagacgcccagtcaagctgaagagaaggtgcccctggatcaccaatggctttcaggcttttatttggatatttggtctttctgctcacctggagagctagaagattgcaaatctctgggatgtttagcagttttccccatttttcagagcagagaaactggagatgttgagcaaaatccaaacagaaggaactgagagcaactcattgcaggagggctgccagcctcaagagtgtcccaaggcaagagggatggaaaccgcgagccagtgtgcttctaaagtatgcatcaaagacacatttaaaaaaacatacaaaattagatgtaatttagcatctaagttctttacttaatctgcagtaagtttttggcaaaacaatgcagtggctccgaggtgttcttgccagaataaaccttgaagccccaaacttccaagagtgaagggggctacggtgacatggcaatgctgcaaagacagcgccgcagcactggagagctgagccagcctggggccgagggggacaggaatgcaccgtgtggacaccaggctgccaagaaccatgccctgccgctggagacaggagacaggcacccacgcagctgaccaaagctcgaccaggccaacggccaccgaagatgtgccacctcatgaagcgagggcactgcttcctatctcaggccttttccttcactgaaaaacttcaaaccaaaccaagaggagtcatttctcaggaagaatttagtgttattaattagaactctcttaagtgagagggagcctgttggctgcttttcttatcacctttggcaaccaccctcacctgtaaaatcaagatctaacggacgtgcgacatggcaacccacaggaagtctccttaagccaagacttgcaacagaagcccggcaagcgggacagaccggcggacagaccgttccacgtggcggctctgcgtgttacctgccccagcttcccttcttcacaaaacaaattcacgtgtaacttgacccatggtttctgggctccggtccagtagtcagttttgataaatagattaggcattacagtatttacactttcatggtatcaagcaatacaaaacacaaccacaacaatggttactggccttcaaaagccgttacaacaagcttccctgatggtgtccacagctttacaaatgctggttcttttcttgatggggggaagagtgggtgggggacaaggaatagggatgcaaggaaagagggtcacatggaaaacactgatttccaaaatctgctatagtcaataacattaaataggaataaaaccttgtaattatagacgcgcgcgacaataacatccacatgacggcagagccaagacgcccatcagcttgtgtgactggtgccttgggtggcactctatactcatcacaccggccaacagtgataaatgccagagagggtgtctcggccactagtgaaatgaaaagaggccagtgtgcacgtgctggcccggtcagggccagggtggccaagagaaggtgcagccgagaatcagatattggcttcagggtcctttccttttccctccaatgccccaaacagatgttcattcaacatctgtgcaggcctcacccatggccagatctgggcacaggggagccacgccactgttttcaggtcaacagcctcctcctccgggagatcagcgacaacagaatcatactgggccagtcagtcatgatagcgcaaggcatactagtgccccttggtcagaggaggtctccgcgggcacagacgagggtcaaatgacaaggaaacaggtccaggggcttcggagagagagagaaagcccctggaccctggaggtggcttataggaaagccagccctgggtggtggaagggaactgaagcaaggaatggctgcagattttaaatgtccactccaaagggaggactggaacttcaaatttagtgaccatggccagcaatggacactctcaaagggcaaggagttaagggcttaaataaggagataggcgagacaccgcatcaggcaccatcaccctcacagcagaaaagtgattcgcagtctgtcttagctctggggcgcagaatgtaaatgtagatatacaaacatgtattttacttcttgttactcagcaaggaactacagatacatgcctcactgcggccaggccacagggcacagcaaaggctatcccgtggcctgggagtcttcatctgaactccggctgttgtcgctcttcctgaggcctttccatgtgtagcccacaaaggttgggctgatgggtaagtagctgaagcatctgtatttttttataatgttcatgccaaatggcaaattgtacgactccatgccgtcgagtgatttgttccctttgcccacacccttcttccatttccggattcctctttcctctggagtgcctgtcacacatcccaagatagaacaaaggaatgcttcgtttagcagctctactgaaaatgaaactgtcgtcaaacacatacacacacacacacacacacacacacacacacacacacacacacacacacacatggtcccacagatcaaacctgcctagataacagcaaagaatacttgaggaggtgaaggtgctcagctatccagtgcccaaaccagaagtctaagaagcactaacccctccatgtcctcattcaagcaatcacctaatgaccttctgacctccctatccttctatgtgacccatattctcaattttcactgttagggcccagctcaggccatgttattgctttcctggttcattctatcggtctcccatctggttacctagtcttctggctcatcacctcctgccccaggtctgctcaaaaactacctctctaggccaggtgtggtggctcacacctgtaatccaagcactttgggaggccgaggtgagaggatcacatgaagtcaggagttcgagaccagcctagccaacatggtgaaatcccgtccccactcaaaatacaaaaattagctgggcgtggtggtgcatgcctgtaatcttaactactcaggaggctgagacaggagaattgcttgaacccgagaggcagagactgcagtgagctgagatcatgccattgcactctagcctgggcaacagagcaagactctgtcttaaaaacaaaacaaaacaaaacaaaacaaacaacaaaacacacaaaacaaactctgtaaaatgtaaatctgagtcaaaaaaaaacctctttaaaatgcaaatctgagtttgcaaaacagggctgaatctttattgtatcacacaatgccttcatcaaccagtcactgcacattcacccccccatctagacagacccacacttcatgctgctttgctccattttagcgtgtctggtgctatgggggacacacaggtcatgtacctgttgtgcttctgcggggatgaacatccaccggttggacactcctggccactctgcaccctgacagatgggtcagggaggaagctctgagcacacagggctcagcaaggaagctcatgacttttttttatatctaagctctgctctctcatcagtatttcagaaataaagctgactttaatttccatcagcctgactgttgcatccctctctcaattccctctggcttaggagagaaagagagtagtcgttatggactcttaaatccagtgccttccatctatttgtgtgtgtgattccttctgccttggtttccccagcaatctcttgattgaggttttttattttttttggagatgggttgtttaaaggggaaaatctcaacaaaacctttgagcctaagaataagtatcacccttccttgaaggcagggaaatctgccagtatgtccatggcagcactttacagtggcccacagcagccaccgccaaggcaggacccacataacatcctagtctgtcatcccaagctcagcacagaatgtatccataaacagggatcatgggtattggagaggcagctgcctccaggcatctcttgtcaatgatcctggacccctgatctcagcctttgcccatggtcttctactgccttctggtcttagttggctggaagcccaccttaggaacaactcatttaagggacagtctccccaagcagaagtgccacgggctgtgcccacctctctcagatcagatgaaacccacactgcagggcctttggcacaggctgtgcagggggacaggagcctggcctgtgcccatcccactgccatctcaccaaacgcagcgaactcagctgctgtctcccaaaagtccttcagcacgagaaacaaaattaatcagtttatgtagcaaaaaactgattcatacatggaggctgggagtgccatcacaactgttttagaaaacagttataaccagtgatggctttgaactcatttactcttcccgttttccatttctatttggcaaaaaaagtaacacatatgttaaaaaataaaaaaaaaaaaagtgtgtttgatatataccacgtacctgggatggtgttatccaggataaaagccacacagccccctacaaacatagcagttgtgagaaggacgttcaacacttgatcgattcctgttatccctagaaagagaacacagccataaacgatcagtgccacagcagcggtgagcctgcccttgacttgggaaggggcaatggtgtgggcagaactccgccaatcaaagcaggaaaggaaagtgtacatttcttagttgtgcacatgtagatgaatttttgccagtaatgttttaaactacgatgaatactttcaacaataatccaaaggtatctccataaggagaattcccaacagtggtgcatagaagatgaatctaagagtggtgttcaccctacaacgaactgtgaagccacaggggtgtagtcggtggataaaaaaaattctaaataaaaaaaaatggtagtcataaggctgagaaaaaattacaaagtgaataataagatgacaaaaatatttctggcacctgcagtcatagaagacttttcagtatcctgggttatcaattagtgcttagctgcttttaatcaggggcaactggatttataaagatgtcctcccatgaatatgacatattaaatgtaaaaaacagcaagaatctcatttatccacacactttccatccggaagatagaataatcctcaacagaaaatcataggcactggtgaggatgtggagaaacagaaaccctcgtacatggctaatgggatagtaaaatggtgcagccgccatgaaaaagtttggcagttcctcaaaaggttaaaaatagaattaccacatgacccaattattccactcttaggtatatacccaggagaaatgaaaacaagtactcaaatatggcccacattgattattcatgaattacgtgtttgtgaaattgcccatacactaaaatgtatttgtaaacccaaaatgaatacccttggtgccttcatgggtatacagagcagtgaaaaatctgagccacgccacatacattcctgactgatgtcaaataagctgacgctctgccttgttctggcctcatcctgtaaacaagagtcctttttgcggactatgtagtgccatgtctgtcataccgtgtgctttccgttggtgatctcactgtttaaaatgtccaagtggtgtgaagtgctccctgacgtttctacacataaggcggctatggtgtgtgttaaagaagatccatccaggcatgagctgtggcattgctgactgtctttccccagcaatggttcagtatttgctaatactgcttgtggcaactctacgaaacataacttcatgaataatgagaactgattgtacttgcacatcaatattcacaatagccaaagggcggaaacaacccaaatgtccatcaatggatgaatcgataaacaatttatggtatatacacacaaaggaacattatctagtcataaaaaaggaatgaggctgggcacagtggctcacgcctgtaatcccaacactttgggaggccaatgcaggtggatcacttgaggtcaggagttcaagactagcctggccaacatggtgaaaccccgtctctactaaaaatacaaaaattgaccgggtgtggtggtgggtgcctattatcccagctacttgggaggctgaggcaggagaatcgcttgaacccaggaggcggaggttgcagtgagctgagatcatgcccaggcctgcactccagcctgagcgacaaagcaagactccatctcaaaaaaaggaatgaagtactgctacatgctacaacatggatgaatcttgaaaacatgctaagtgaaggaagccagatacaaaaagccacatattatgactctatttatacctagaatagaccgtgaatccatagaaacagaaagcacaccggtggctgccagcgggtgggagcaggcggtgatggggatttactgcttaatgagtttggggttttattttggggtaatgaaatgttttggaaactggacagaggtgatggctgcacaacactgtactagatgccattgaactgcttaaagtagttaattttgttatgtgaatttcacccacaaaaaatatatgtataaacaaacactcctcaattctgcactggctaagatattaccagtagcaatggctatgtcttgagacggttcttcctttctacattcctcaggacattgcagtgttaaaacaaaaggaggagttaaaaaggttaatcttgaatgcacaagccacgtgattttgctctgaggagttaataggatagacatcaaatagtagaataacgtgttcaaagtctatgaagttgagtttcaaaaaaaaattatcttaatggagcattagtctattaagatagactaatgaaatcaaaagcatttagagagaggcattctcccaaaggagagggtcccagtgaaaaagagaccttagcatccatgactgttatgtgtacacgccagcaggaagcccacagcgcttccaggtaagtattgaaaagtgagattcaagagagatccacagacgcatctgcaccacagctcctggaggcccaaagtcctctccaatgggcaaagagctgcgtgtggactggcggctgtggttccagctcccactccaagatgtaaagcccatttcctcacctgtgaccagagggttctgtctgaggtaacttggaaggacgagcccaaagaagatcgaaaatccaagcacaaagaggttccgggaagaatttaaatcaatgaactgcaggttagagaggccaacagctgtgatcattcctggagaaaaacaaaccagaccacaagctccagcaccactacagcggggacagctcaaggcaggtgagggcaggctccctggcaccccttctctgtccaacagaaaccaatgagaccagtgcagggacaggaagggggacgtgtggggtcagactgtagccaccctgcgctctgagccaaatgaccctcggcgtacgcgctatttgggctcctacgggagcataaacaccatgtggcattttgtttgtcaaatagaaaactaaggacattggttctctctctacacaaacattttgattaaacagggagacctacctaaatatctggtgcatgtctctggttattacagctaaatggtgcagagatcaaacccagagtcccactgtcaaaatggtcagttttaagtagcccattcagagggatggtatttgagttaaattggtcagaaatactaaagagattaaatttaattgaaatgttcatagcacaattacatcttattgttggttccatatttaatataaattcaactcagagagtgataaaagttttcattttttgaaggcatatcctttgtattttaaaatagaaatttatcgttaccttcttactgaagggagtcagcaaaaacaccatgacccctattaaaaatttggaaaagtaaaggaaaaagccagagaggggagtcttaccaaagagcgtgcagaacagggctcccagcacaggatccggaagggacgcaaagagggcgctgaacttcccgatcatgcccagagcgagcatgagggctgctccgcactgtatcacgcggcggctgccgacctgcagaacacacaggagactgggaaacagggactcatctccatgcaaaatcaccgtaagttactaaagaacacacagcagagatacccatggcctggctcgctaccttcacctcctcctcagcccactcttctcacctccactgtggggaccctgagggccgccctctgcatctccaagccttggtgacactccctgcactcaggcctcagggctctactgccctggcacagtcatgggttgggatggccgtctgtgtctcaaatgcaaaggccacactttgcccctgcctatcccctgggttcccggcaccacatgtcaccaaggcaatttcccccaaagtgcttcagcctcaatgccaacttccccacaccggaaatcagaccaaacccccagacatgtctggaacctcctctcctcacggcacgcttcccgtgagaggtggaaaagagaaggggctacggatgaggacatctggagcctgactgcgggctcttctcctggcccacgtctgactgtatggtcgggccgacccgtagcctctagagtctcaggatcttcatctcagtcacacacaagcctcgtggttttgttttgaggattaaacgggacctgcataaaactgcctgaatggtagctggcacgcactgagccatctgagagccgcccacatgggcctgctgccactggcctttcctgcacccattccatggggccacggggtcacctttctaacacatgaaattggggaggctggtcccctgcttgcatcctctggtactcatgaaataaagcccacttctcaggctctttccaagcacaccaggcaggcctgggcctgtctacctggacacccttccctgtggttccctcctagccagatcctagatgcatccttttaaacatcacccaaatgctcctctgaaaagcatcccaactccaggactattcccccattataggctctcatagcaccatgtagggcatatctgctactcctgatctctgcctcccagcagcttctgtctagcctgctgtcaccagtcatgggttgggatggccctctgtgtctcaacgcaaaggccacactttgcccctgcctatcccctgggttcccggcaccacacgtgagaggtggtgctggcatcaggctcaggaatcctgcactatgggcccctactctgtgctgcctcttgcaggaaaacaccctaaggatgtaaactgggtaaaggaggttccagagtgtttgggggagtatccacaaggatttatgtatgaccccagtgaggagaagagggttgcttcaattttaattaagtaaaatgagacaaaattttaaacgcaattcctcacgtacaccggccacatctcaagtgcccaccaggcacacgtggctggtgcagctgtgtgtgacatgttgaccactgcacagaaccctcaaaggaccagggtcagccagttacgcatcagagcctgatctgaggctgtgcacatgagagatggctgcccagctggactcagtcactgtctcactgtccctagcctgccccacaccacagacggcagggaagcaatggaaaagatcactcaaactgacaaatcaagcaaaagcgactcatgcttggctgttactatggaataaggaaggctttcatttactaatggccctatcttcagcaaacattttcgaggaactatgtaattatttgatcaagcttgtgacttgttagactgggacaggtgaatgcaaagatgaataagtcacaagcttgatcaaataatctcactgctatgctgttctgctgttgggggagcccagcagcagggaagagaaaatctgaagagttggggagggttgttggagatggtcctgaggggtgagtaagagttcgctagtggaagagcatccaggcagaggaaacagcctatgcaaagactcctggcagggtcgggcaggcctgttaggtatgaagggccaaactggccccagggatacctgaaactaaatctggtagcaaagtgacatccagaagactgatctgcctttgatgctgtcaacaatatatgcagcaactaagccattcttgtgttcaatgaatattgaccaagtacctattatgttttattctaactaccagagatagagccctaaaatcccagccttcccggtgcttccccaggacctttgcttcccctctcacagggtccattccctggaatctccttggcacctccctcctgaactgtggctctgcctctaggaccttggtaaaatagaccctgggtttctggatttacaaagtcttcaacggtggtgcagaatgcagcaaggagaaatgaccttcctctggacaccaacaaagagatctgacggccagcgagatagtacttgctctgttcctagaaataaactaaggggtaaatagcaataatgataataacgataatgatggaccttgctggtccaggtagggaggcactcaggtgccatcattccttcatgcaatatagatatttatgaagcacccgctctgccaggctactgttctaggcacttgggatacatcagctcattaaaaagtgctggcaaggtaacttgtcagagtaagctagcaccattcaaattttaataaaaggaatgatttcccaaactaccttggtggccacattatatgatgatgtgttttaaaggggtgcagaaggaggaggcttgttacaccatcttcccctaagattcccttcatctacaacaattttactcctacagtcgtccctagggaaccttgaattagttccaggaccgccactctccccgcctcagataccaacaaccacagacgcttaactccctgatataaaatggtgtagtatttgcatgtagcctacacacatcctccaatatactttattttatttatatatttttttttattttttattttggagtcagagtctcgctctgtcacccaggctggagtgcagtggcatgatctcagctcactgcaacctctgcgtcctgggttcaagtgactctcctgcctcagcttcccaagtggctgggactatgggcaccagccaccaagcctggctaatttttgtgtttttagtggagacaggggttcaacatgttggccaggctggtctcgaactcctgacctcaggtgatctgcccacctcggcctcccaaactgctgggattacaggtgtgagccaccgtacccagccaatatcctcccatatactttaaatcatctcgacattacttacaatccttaatacaatgtaattgctctgtaaatcgttgtcagactgcattgttcagagaataatgacaacaaaaagtttgtacatgctcacccagaacagtacagaaacaaacaatattagttcagaaacaatatttttgaattgaagttggtagaacccacagatacagagggccggctatcttatttgagatttgggattagttatatgcctgcaagctcatggcagcaaactggctgaagagtggcatggcttaggccccattctgtgcccatgagatccttccctcatctccctgtgctcagcactggcttctcaccatgggtagcaaaaggacctccaggatggcgctagaggaagcgcccctcagacaaccttccctcacatcccccatacagggagcaacaggcagatggggccattggcacacctcaggctgagctctggcagggccctgccaacctggggaaaccaacaaacaaaccaggcatgtgtgtgcctgcctggcagctccctctcacctggatttgcaatcaaggttaatcaaacttagtatctggtttctctttatctgattatagaatcttacatggcaaaggagagctcttttgaaatccactcctccctcccaatttgacagaggtcaaccagttctagaaggtttccgggctcaccccaagtcctcagtgagggagacctgtgagacgtaggccatcgaggatggtgaaccaattttcatggtcttagtttcacaacataccatggccaatggtgggtcatctcttaatttaaaactagtgacacctcccagttgggatcccatttctaccttttgcccagccccccatggtctattctcatcactgcagtcaaagcgatccctaaaaaaaaaaaaaaaaaaaaaaaaatctgaccaagctgctccctgcagcactcccttccactcaggcagtctgtggctgcctacctacctgcctgcctgtgtaacctgctccccagttacccggcagaccccacctgctctgactccctgacccgcactggcctccttgctgaccttccacttccaggatagggctcggccctggccacaccctggcctggaacgctctcccccaggttatttgcaggctccctccctccacccttcaggtctgtgttcaggtcacctgatcaccctctccccaagcttcctgtcccatgtttcccccagtacttgtcactggctgacataatgcatcatttatggacttagtatgctgattgttgattgctagaatgtaaactccactttttaattcactgatgtatcccaagtgccttgaacagtggcctggcagagtcagtgctttataaatatctatactgcatgatggaatgacagcactgagtgcctccctacccggaccagcaagagaagagagacttccaaacaggcattataaacacttaaaaaaaaaaaaaaaaaaaaaaaggagagaagtaattttttagaaccagaggcccgcccatttggaacttgcagtggccagatcgatcaatgaaatggaccaatgcttagaaacccaatcatttaattagaaaaatctgtgtacctttgtaattcccaaaactccaatgttgggactggatgaagtagagccattcccagtaccaaatatgccatcaagaacacaggagaggccttccacgaaaattcccctaagatgtaaaggaatggaggaaagaaaatcattcaatgggataatgcattcactctgaaatagcctctacacatctacaatccaaaaatgtggtccagagcctgcagcttccacatctcctgggagctgggagggcgattaaaaatacaatctcagaccccaccccagacctgctgaagcagaaaagaatctgcattttttttttttttttttttttttttagagagtgtctcactccgtcacctaggctggaatgcagtgacgcgatcttggctcactgcaacctccacctcctgggttcaagagattctcctgcctcccgagtagctgggattacaggtttgcaccaccatgcctggctaatttttgtatttttagtagagacggggtttcaccatgtggccaggctggtgtggaattcctgacctcagggtgatccgcctgcctcagcctcccaaaatgttgggattacaggcgtgagccactgtgcccggccagaatctgcattttaacagaacccccaaagctcattccattttgagaagcacatctctaaatcacacgttagatttgagtgtttttaaatcaccgcaaatgaaagcaaaggattttagccagaaaataaagccatttgttggggtataagacaaacatgggccgtctatggaaataaaacattgatgtgatcctttactcttaaaatccagtttcatcaggaaggaaatgttttataatttcataagtactgacacttttaaacatactgatatacaggtatttaatcatgtgcagcagctccattagagaaagatggggacatcaggtaccagagccaaggcccagtccattaatctcatcacacacagtcccttctggggttacagagctggctggagaacaggaggggatctgggctgttttcttttctctgcagactcctcaggggcaatcatctgacaacttctaaaagctaatcataaaccccatagttcataagccctagatcccacagatttcattcatttctgctattcctgtccctatttatataaactgtaactgtgcatagattacacagtgcttacccttggggacaattggaacgtatctaattgacagacctggggcatactgcctgctgctaaggtttccactacaggggagagcaaacggtatccttgtgctttctgtctgtccgattgtggcagccaagattgggtggggaaacagggaaaaaaacaggtaatttttgcaatgtagaaatagcactgtatagccaagtatggtggtgcacacctgcagtctcagctactcaaggtgctgaggtgggaggattgcttgagcccaggagttcaagagtgtggtgcattacgattgtgcctctgaatagccactgcactgtagcctgggcaacacggtgagaccctgggtctttttaaattaaaaacaaacaaacaaaaaaaaaacaaaaaaaacctgtaagcagtgaagagcttgttttgctgggaagaaaaatttcagtttgtgtaaaaaaaaaaaaaaaaagaacagttggaaaggcaagataacagaaaatcaaagtagtgctctctatctctctctctctctctatatatatatatagacagagctactttgattttatctatctaatctccaaatgacacacacacacacacacaccccaaaaaaagcaaagaacaagtgcagtgcttggcatgtggtttttgaatttaaggcttacagtggtttcgcagagagtgtgttatttgatgtcactgcaattaaggaagggtaggaattccgttccacgtcatggacgaggaaaatgaaagtaaacaaaggcagtggtgtatcagacagtcgaaagtaaacaaaggtggtgatgcatcaaacagtcgctagagtcctgctgcttggctgggctcctgctgaaactcttggttttgtcttcaaggtaatgtaaacctaagaacaaagtaacaaggtgctgggaccaatcaggaacttgtcttctcaggaacgtacctgtttattgcgtggatgggggggggtggggcacaggacagccgtgcacaggcgtagtagtcaccaatagactcgatgatgctggcgaccacggcactgagcatgccgatgacaccggccgcagacacggtgggcagtccccactgaactgtgggaggaaaacaaccatgaatgctcctagagaggcaggcgaaagtgaccaggaccagttacccaaagtcattctgaacgctgcaagactctacaagatccacttggattctgaagctcatggaaactgttcattttaaaatcttaagcaccagatgcctgggacagttgctaagtcagatgaaggcggccataatgaggactgatgtgcactgtgtctttaattaaaagaaaacatcgtagccggatgcggtggctcacgcctgtaatcccagcactttgggaggccgaggcaggcagatcacgaggtcaggagttcgagaccagcctggccaacaaggtgaaaccccatctctactaaaaatacaaaaattagccaggcgtgggggcatgtgcctgtaattccaactactcgggaggctgaggcaggagaatcacttgaacctaggaggcggaggttgcagtgagccaagactgcgccactgcactccagcctgggtgatagagcgagactccatctcaaaaaaaaaaaagaagaaaaagaagaagacattgttgggctggaagaggctgtaacttctctttcctgcttccaagccacactcagtatccactaaataacaactgaaagtgccctgccacgttgggaaatttgtatgagggatttatagccctgctgtacagagcagggtacaaagcagcagtggccttccccaggggaggacatcaagtgaaaaggcagtgagaaatcaccagctaaacttaaatcccaacagtaaagcatccataaggtatggacagtccttctctactataataccagaaccttatttttatatcataaaccatgttatgggaaattaaatagtttcatttcagaaagcaaagtgaggccccactgaaacttcattttaagttccgcatttacttaatccctcattagatacttttttcttcacaagtatatttatttggacttgaaagccataggtcttacttaacaaaaatagcatgggtctctttcgtgtgagaatgaatagactcctttgataaaggagtagcccttcttccgttgaagcattagttataatacactcactgagcagaaagcacagtgggaaaagaacgatggctaaaacatggtctctcatgcaggagccaacaacgtagctggggacacaggacactccaaaagatccagggagagggaaattgctcaacttcaaatggaggcaagctgagctgggtcacaagaagcaccagtgaggtggtcaggaaaaggcgaagtcgggccctggccagggaaggatctgaggaggaggtgggaacggaggtgcccctccagggatcgggagggtctggagggtggggtttgagggtgttctggtgaacgcagagctctcatgcagggcacagggcaggaggcaagttctggaagtgttccaaaagccatctaagccacctagaggggtttggcctgtgttgtaggtagcctagagcaaccactggattgggaagagaaaggatacaaagtcagacgtgcagaataagcctggagtgcggttaagggcagaattgctcctgcctcaggcttgttcattctgtgggagcagccaggggatgcagaggcggcccttggtcaggggtgcaaggtacgcaggttgatggatggggctcgacacaccctatgccaccagcaagaggcctgctcaacgtatcagctccaggttaatttggaatggattttcctcattcagaggccttcctcaccaaggaacattttgctttttctcaattatcttttatactgttatcttgttattgttgtagcattctggtttcaagaattctggttgtagcattcaagtttagtgtcttgattttgaagggggattcttattttgatcctttttccttcagatatatatctatatatctatatctatatttttttttcttaaagaccttgttggcttccagccttctctcttgaatctgttatttcatatctccttttaccaagaaactttcatttagtttgttacttgacagcagggtttttcaacctcagcactgttgacattttgcaccagaaatctgtattatattaacaatcagtccagaccatgcctagtgtactaaagactgaaaagcactgctcaggtattcaaaagcccctctctggcttgagacaaagcactggagagtactacatatgtatacagtagtacgactatatccctggaggtggctttctagctatggagctctggtaccccaccagccctcggcaggccaggagccctacgtgctcgctcacggccagcacaacctcaggcgctctgtctactaagtttcgccttctcgtgtgtggccccatgggtcctagtgaactccctctggccccagcacctgtacagctgcctctcctggacagcccagcttgtgcccctactggcgcccaccttgggagttgcctgcacaagcagaagaccaccttgtatacgctgtgggggcttctacctacctgccacccccgcctcgccctcaccctgactgcctcaccaactaattgtaatttcattttatctcagactacaggtatgtttatgaaccatgcacattctttcttggaaaaagaataggtctgtataaatgcacacttagaccatacaatctgatgagaaagttattttagaaagatgaaacttttttttttgagacagtcttgctctgtctcccaggctgaagtgcagtggcgcaatctcgactcactgcaacctccgcctcccagatccaagcgattctcctgcctcagcctcccgagtagctggaattacagacacccgtcatcaggcctggctcatttttgtatttttgtagagatggggtttcaccatgttggccaggctggtcttgaactcctgacctcgggtgatcctcctgcctcggcctccccaaagtgctggggttacaggcatgtcccgccgcgcccggcctgaaagacgaaactttttaaagctttcctaagtgtattgagaacaaaaagaacagccaacactcatcattcaacatgctcagagcagtcatctttaacccaaccttaaaattcttggcttctctctttttctccttgtcattataaaaaatgaaaataagatggttacacagggaaagaagtgggctgaacctgactaagctcaggctccaattctaataaaaacccagacgccgggactagagtcttcacaatggaaccaagtgtgtaacaaccactgggatcacctacacggggccagctgcgagtccaggtgacaccccagctagggaatgtattcacacccccaacagttacacaacactcaaattaagatgcagcttttggccattagtgactatcaacttacctctacagctgtggccaaatttaaaagattatggctgcccattaagagattatataaattccatcatgcttgagcaggttgcttgctaatccccaggctgttcccactcacatctttccactttggcagctctgggaccaagcagctctatacttgcctatctaagcagctgccctcaaatcctggccaccagagcttaaacctggcaagagaccccttgtccaggatttcatcctagcagatccaaaagagacagctcgctaatgtgagaagggagccggtcagtctctgtgtgttggtttctgccctctggggacagggcctcccttacttgctgtctaatcctctcctgaccagaatggcaaggccttcaggagacagtctgggacaaagacggctgttctgccaaattcccacccctctcagttgggccctcgtgggctcttgacccctctagccatcagaatacttacatgggtatggaaccttaaaccacggggctaccagaagcacgccttgcctggcatctgtgcgagcatagaagccatactttgtgctgtcgggagggaagacatctgtcaccgtgaagatgaagcagagcagccaggataccaggatggccaggatgatctggagtggtcaaggggaagctctgtcaggccagcagggctcacaggtgttggcaaaaaacacgtcttcccgcggtcggaatatcacaccccagagcccaccacagtcagtactttgcagaccttccttgaatggactctcactgagagagcagtttcattcaggtgaacttatcttacccattccaaagtctggctggtaaaacaagaatggacatcgtgcctgcagaggccacgtggagtcaaatcttactcagtcccaaggacagtgtccccttccttcggcactgctaaaaggatgtgctcccatttcagaatcagaatgtttaagtctatgatgatctgagtggtcattagtagcctggtctcactgcacagatatgatcccccaaggagggcctgcttaaaaccctcccttcacttaatcatcttacatattaaccaagggcaaaaatgtcagcaggggaagaagtcagctactcacagggaacattttgaacagctgtaacttgtacgcagtccatcctttcttggatttataaatcgggagaggaaatttaacatttctggcgtattgagaaaacagtaatactaggaatattgtcctgaggagagaaagaaaacaaactaggtcaaaagctgttatgtctctgttataaaataacactcgaagcttctatggcaaaattgacatagtgttcaattcatttacctagaaagctgctagtcctctgaactaccatttgagaaatagtatatctattggaatgtacatcttttggaaatactactgtgggggaagatgttacaactaatttgcctagcatttcttgatactgaaatgaaattctgatgtaaatgccttaggacagcttttcctaaatagaataagaaaacccaaagaatgtacacattgatgggaaacgcttactctatgtaaagggaaaggatgccagatacaacataaactgtaagattataactatgaattaactacaaagcaaaccaagaaactactgcacgtacacacaaacaggtaagaaggacatgatccaaaattctcccagggattcgctttgagtagttacatgatttgcaactggttttcccacttttctgtattttccaatctacttacagcacgcataaattacttttaaaagagcaaaaagtaagcttcactgctcaagaaaagtagatacagtagaattcagtattaataacattcctgggaggcttctgtgtgccagacattacactaatgtcttcctgtgcagcatctcaaccttacggggtggcttctaagatggtctccttttcacagagacaaagccagaggtccaagatcacacggctagggttgtagcactggggaccaggaatctagctctatggcttgaactgaactctttccttttgccaccctggtcacagggcaaggaggctgggctgcgtaagtccctctccttgagcctcacggtcctgactgaactgcactaagtgctatgggaggcaggtgctgacccctccacggcaggaccatggcacttcctgacacaccagtccatgacatcggtctggtgtcccacggggctggcaggtgtggggccacttcccatcccccaggtggatttttactcatcaccgaaacaaaactcgtgcccaacaatgcgtctaagcctccacgcggtctcgctctttcacttacaacctgaggtagagctggcaggaagagtaggttctcagtcaaagctaagcttaattgttcctgggcacagttccaattgttgagatggaatcattagccccatcgacagccggtcaagtgtgactccactgtcacattcctaatgaggtgtggatggcagcccggctggagaacatgcgtgtgttgctccacgggtctccctgcctactcaggcgcttcggtgaactggtgatccatcaggggtctctgccagtaccagttcaaggtcgaaaacacacacagtgcccacgttatttcaattcctctgggatagtgaagtttaacaaaaaacaatatggtaacaagggatactaaaactggaatattttaaacttagacctacatgcaattttcatgtctggaaaaaataaatgctacttatttgtttcagagtgaatattaggagatccaaagatgccccaggcctgctagttttgtcatcattatttcaggcaacacacctgcacatttaagaggggactgagaccacacagaatttgaggagggacacccagatcttaggcccaaatctggcaactcaaatttagaaagcagattaggtagcagatgaacatgactgtttctttctgctctaaaacctctctacttcgagtttatttttattctcaaatacacctgggggcaggcaccctgtgacagagaggcagcagcttagaggtgcagacccgcccatgtccacacatcttaactgagcaaagggatgaagcgttctagccccagctctcaggatgggctgctgtctactccactgggtgcttcccacctcatgtttacctttgctaacttttactttaaaatgttacgcaagtaatacatactaaattgtacaaaaaatttaaaagacagataagcagaaagaaaaagataaaaccctgaagatcatccataatcccccttgagtgataaaaccatgtaatatcgtggtctatctgttctgaacagttttcactccctggatatttgctgggtgctggaggaagacagattgtcatcttccttgtccccagacatgaacaggttattatctaagccaaactggaatcatgctttacgcagcttcctgacctgcctcagtatctatttgcttttccgcctcatcagacagagatttgcagcagcaccttagtgactgcttagcattctgttttatggacataccaggggacgggggagggatagcattaggagatatacctaatgtaaatgacgagttaatgggtgcagcacaccaacatggcacatgtatacatatgtaacaaacctgcatgttgtgcacatgtaccctagaacttaaagtataataaaatataaataaataaataaataaataaaaattcccatactgtatgacatcagaagcaacataaacagctttaattgaaaaactgtatcatcattgcttctaatactcagtcttttcacgttgaggtatatatttcagcattttttttggtagcagcaaaaatttaagctacatgcatgagcatcagctgagaaatggctgaatacattatagactacattactaaacactgtgcagctttagaaagaaagagatcatctaaacatgctgtctcagagaagtaaacccaacaaattattggggtaaaaatgaataaaattatgtatatatactagtttgtacttatttgcataaaaatataaaaatatgtaaggataaaaacaaaattttttactagttaacaatcatgagatttttttgagagatggagtaggaggggactattattttgctttagatttctgagcttaattactgttaaatttcaaatacctagaatttaactgaattggagggagctgaaaaacagtgggatatagataaaagtatactgttttggagtgcctggtattgacacatgggggttcattaaactattctcttcacttctgaataggtttgaaattttccataagaaaagtcaataaaaaaataagttttaaaatgtaggtcctaccaaggacgtatgcactgtgccagaaagagcagtcactgaccggccgcactaaccttccctgagactccgtctctaaactccatctccatcagagtgacttagtttgtacaacctcattcactctcaattccaacagaatcatgtagataatacacattttaataaattgggaggataaacctttttcacactttaatgagctaggtgtagtcccttttttgccaaatggctactcctatcacacccttcatctattactccactgggattctctcacttttaaattaaccagtagaactctttacgagttagggatgttagcctttcttgtgacatttttatgagtattttcccagctttttttttgagacagagtctcattctgtcgcccagactggagtgcagtggtgcaatctcagctcattgcaacctccacctcgtgggttcaagtgattcatgtgcctcagcttcctgagtagctgagattacaggtgcccgccactacacccagctaattttgtatttttaatagggatggagtttcaccatgttggccaggctggttgagaactcctgagctcaagtgatctgcccaccttggcctcctaaagtgctgagattacaggtgtgagctgccacgacagatttgtttttaattcagtggtttctgacgttttaaatgtgtcaatagtaaaatctatctttctctttctcttttcaatatctgctttaagaaagatctcccctcccttaggattaaaaacttatttaggttttcttctagcacttttatggttattttgtatatttaagtctttaattcaactgaaatacaatttgatataaattaggagtctaactttttcccaaaaataattagtttttcctacataatttgtccattccccactggtttcaaatatgactgccatctatactaaatatttatttttctttgattctgtttctgttcttcttactctgctctgccaatgtctacccctgtcccaggaccacagtattatttatgaagttgtggaatgtatttaattcctctacaggcaagtcaccatcccctctcctctctgatctttttggtatgggtccacattattttactttcttgttttataaattgactagcacatctagaataactttaaatgatacccgtgataataaacaagcttatttaagttcctgacttcaaaaggcaggactgatttgagtctttcatcattcaagtaggaggcatgtttatcttacgcataaagatccttctatacagccaggcacggtggctcacgcctgtaatcccagcactttgggaggctgaggtgggtggatcacctgaggtcaggagtttgagaccagtctggccaacatggtgaaaccctgtctctactaaaaatacaaaaaaattagtcgggagtggtggcggatgcctgtaatcccagcgacttgggaggctgaggcaggagcattgctggcagccgggaggtggtggttgcagtaagcgagattgccccactgcactccagcctgggcaaccagagtaaaactctgtctcaaaaaaaaaaaaaaaaaaaaaaaaatcctcctattctcacattgctaagtttgcaacaaggatgtaggttgaattttaaaaataaaattcaggggaagggactattaccatagttttatcaataagaccttattaataaaatctaccctgtagtcccaggtactcttgggaggctgacgaatgagaatcgcctgaactcaggagtcagaggccacagtgagctgagattgtgccactgcactccagcctgggtgatggagcgggatcctgtctcaaaatttaacaaataaaaaaaaacctaccatggagccatgatcgatttcaacacattttctaatatttgatcatctgtgaattcttgaaatgacgcattatgccttgttctttcattgtgttatctgtagcagcatcttcccaaacaacattctaaggaatagtctgtcaagatatgcttatagatgtgtgacatttaaaaaacaaattaagggtggacagggctggatactaaggcccttttctgaaggtgaatagagtcttttgcgcatttgcattttgaaagattggaaggagtcttacagtagagaatgatgctgaactttagcacgctacctgaagacatttgaactcagggctcgttgcttagaatgtgccgcaatacatccatcagctcaggatttgtttgttttttaacacaaccccaggaaagaaaacaatggtccatggttctccttttgtattagttcagtcagaatttgccgctaagattggctggggagtttccctcctttcacagagctctggaacagtttgcaagttagtgcatatagtctctgttccttgaagactgaatgcactcattgtctaaccatctgggcccagggcttcttttaggaatcagagtccttcagcaactatctcggctgctcttgtggtcatgggtttaccgggcttcctgagccttcctttattagttcacaacctgctcactgagcaccagctcagccacgggaggggcaggtgctgggggtgcagaggtgacccacccagagcgtaggccctgctctcacagagctgacagcccaaggatacagaagagctcttggaaactgaaaaaacaccagagcataaatgacaatcttggcagaaggaataagagataaagcaaaggagaattctcacgaatagagaaaaaagacaaagagatagaaaacaggagaggaaacaggaagagtccaggaggcttcaggaagaggttccagaaagagacaagtaagggtggagtggaggaaggcatctagataattcaagatcatgtcccacctctgcatgcctgggtgctcagagcaaaggggctccaggtatccaggccaagagacgcaagcagacccaccgagggcagcacgtgaggctccagacattggaacagtaagaaaaccccaaagcttccagaattctagcttgtgtctaactgatgtttcaaaaggaggggagagaggaggacccctgggagacatgagggagaagctggggacagtgaggaatcaatggccaagggcgagcaaggctcgcagagggtggcggcagtgaaggcctgcaaaagagaacgggttcagaatttgttccggaggaggaagggcaggatgggctgtgtgggggatgaggcgaaaggaagactgaagaacagatagacatttctggctgaagcaactaggggcacggttgtgccattcaccgaaaggaggaaagcagaagaaactggtttcaggggcaggaaaggaatcaaaagtctggggctttttcatttacagatggagatgtcttgtgtaacagtaagtggaggggcaaaataggggctggatctgtaagtatcgagtttacaggtctgaactacaggtttccatggaactatccaccatcaaagaaatgcgatttccttgggggaagtgcatggagagaagggggccaggatcaagtgtggaggcacccccatacttagagataagagtgaggaggagtcaattttggttacttaagttttctgaaaaccactattttcttactttttgttttaatttggggggaggtaacagttttgctccctctgacgggatctgtggcagatctatgtgcacaggcttcctcttatcctgcttagctttgccagaagtttgtctacattgggttttgtttccccctcaagagatcagcttttagatttaccacttctatttgtgtcacattttctgtatctttattaattcgttccccctgcttttactaggttcatttttttgtcctgttttcttagttactgaaattcttcatgtgctgtatctgctttaaaggttgtgaattttcttgagaacacctctggctactaagtgtgactggtgctgttcttgccatcatttcctaaactatcagtaattaattgcaaagtttcaatttcctctctgagagtgatttttaacacttttttttttaagcttgtaagtgctttgtgggttttgttcatccttttgttactggtttcaaattttactgtactatacctacaatttatccattttggcattaattacatttcgctgaaagactattctcacatgccatcttcccatctctgctggtgtgaagaatgttttgaccaacctttggtgaaatgagaatagtaagaacaattttgggctgggcacggtggctcatgcctgtaatcccagcatttcgggaggccaaggtgggcagatcacctgaagtcaggagtttgagaccagcctggccaacatggtgaaaccgtctctactaaaaatacaaaaactagccgggtgtggtggtgggtgcttgtaatcccagctactcgggaggctgaggcaggagaattgcttaaactcgggaggtggaggttgcagtgagccaagatcgcaccactgcactccagcctgggcaacagagcgagactccattgcaaaaaaagaacaattttgggaaagcatgatgatgggtattcatgctcatgtgtgagatgtgtctccttcaaaccttgtttaaagaaaaaaaaaaacttgatattttcacacaccttaatttaatttgtaaagtgtagataacaattctgctatggttcccttttatttgtacgtcatgttctaatacacagaacaggattgagtatgatgggttcgggcccatgtccaccacctgggttttgaaacccacggtggccacttaattcactgtatgactctgggcaaatcacattacgtcgtggtgctcagtgtcctctgctgttaaatgggataacactaggatgtgccttatctgatactatatacaagtgttatataaaggactgatgcatagtaaaagatcaataaataccacctgttattaaataactgcagactatttcacaaaacagagcaaatgaaaaattctcttatgtgatgacttattttgttttaggagttgtactggctggttaaattccagagtaatggaaccatatacctacacataatcaactcttaaacatgctctgcagacacatagagaatgtgggctctgtgttacaaagagttctgtgactctaatcatcagtaatattatcaaactcccctgtgacttcattaacacaaaatgttaactttacttaaagggcaagggacatctttaatggatgtgacattctgtacaaaaggacaggcactgactagcaggaccctggcagaaactatgtccctcccccaaccacccacccgtcaggagtgcagagctcagtgtggcctggggagaagagtcacatcatcaatggcaacagacctttcccacgacttctctggaaatactccagattcctgccactctggaatatttttgagtctcatgatataaaaatttggcttctcagtatgtcaactcatgaacatgagacttggcaagacctcaaaagtcaaaaacaaatggcgccactaccttaccccactaccaaagcttaaaaacttacaatccaccctcttcatattgctgctaagtctgtctttgtaatacgtcaactatatgtcacttcccaaactctgggtcaaaaacccttcaactattccccagcacgaagcaaataaagttgaaactgtcagaccattcttattattgaaaaacattatctcctgaagtctgtgtgaatgttcctaaaggctgccccgcagtggtgggatgaggggagatgtttccacttacagcatggcaatgccccagtgcttcccggctctctcccccgctgcctggaaaccagagaggccaattagggccaccgtgggtgtaatggtcaagggaccgatgtacttcagtagagccccaggcaggccgaggaggccgatgactacttctatcagtgaggacatgatgatggccccctggatctgcaacaagagatggcacagacatgagagtgagctgcttgtacactgcacactcagaatgtcacctacaaccacaactgataattctgcaaggcaataagttattacatcatctaacttgggagagatagctagaaaattccccaggacccgacaagaaacttcagggggcactaactggggcctgcattcatgatgcaggtgtattacagaaataggtcctggacacacggcccacatgcctttttcactgttaaacgatgcaggcaaaaatttataattcccttttaagaaacacaacatttaaagaccagccttagaggaacactgcagcataaagactctcagctttaaagagtgagccccccaggacatcgacaagacaatgttgttgacagaaattctaaagggatgtttttagtgtgcagaatggccacatctgtgctcattctgaactgatggtgaattatctcacacgttttggaaaatattaatacactgtcagccgtacttcatgtctgcttctgttcaattgcactttggcagacaaatatctttagttctttcaatgaacacaggcaaacactgaggccagagcgaacaattctgctatctgtcgatgatgagcctctgtagctccatccagtgagccacgaacctcagctagctgtgctggcgggtgtgagtggacaggtctgtgggtgtgcaggagggaggaaaccattccttaaggttgcccagagcatttccatatgctttattttagagtattgcttaactacatttacttaaacaagagaaataaactatcagtaattgaaaaagaaaagaagggctcagtaaaagtaactgctatttcttgggtcaaccaacattgaagctgagaagaaacatgaagaagccaaaagcagacaacgcttgtcttttacctctcggatccggggataccagatgtgttctgtgtgcaacagctctgctgttccattggcaactgaaacatcttgaaaacaaaaacaaagtttttcttggagtgacactgatgtctcacatgacatattcattttaccttttaagaagaattttctccctgtttttattacatctgtttcaatccccatccctaaaattcaacctccaacagtatagcttatctcactgaaaggtggatcctcaaatgctaatttaaccaaatgaattcatcgactaagagctccccaaattgtcaaaagctaactgaagtggtgatacacgttactagcaccagcctcacacaaaaaaaccaacctttgcacacagctcattgaaatgcccgacagcaaggttgctggactgaggtttgaaaaacttagataaaacagagggccttttccagttcccagatcaaatcagtggtcacaaagtaactcctaggagcaaggaaggaaatgaaggctggaaaactttgctcctagaaggtcaaaatgtaattgtatttttgagagtacaggtctgactctaattttcttaaattccctatcttttcctgaccttatcgggttccttaaggatctttgcaatcactaaagaaggggaatgaaagtcatttgcagcaaaccacagtagccagatccttaaaaagcaaagatgtttcagagaagggatgctgacgcagcaaagagagtgattactggtgggtcataaaatccactgaaagagagaggcagaaaaatagcacaaatatttttctattccgttcccatatttgtcaatttcattaacatagagaaatgaggtcaattctgatcctttcttgctctagggttagggatgaacaagtggacagaaagagagagacagacacgatccacagatggagcattctaagctgtttgtgggtttgtgtgctttgtccctaattcttgaaaggatttagcgctgctgagggcagcacgtccaggcctccctttacacctgcattaaaggaccccaatgacatatgtggaaataactgcaattacctgtggtgttacatttccatttatctaaagacaggatggctcgagcaggggccaaaaatgcaaaagcactggcctgaaacaggggtaacctaaaagaaacgagaccaaaaccatgatcacggcatcgggaactaccgaggtagttcactatttgacagcttaacagtcttttccatagacatacagcacatgagtaaatgcaggcacacctagaagaaaaagccccagtttgcaaaggtttcctgtgccatgcagccacagccagtggcttcttcatcctccccattgccactctcctcccacccaggcagctccagggtgggccccgtggtcagtgccaacaccccaacaccggcccctgccatcaccacctttcctcttgcaggcgggagactgcgggcatttgaggttccctctttcctgctgagcttataaactcctttttaaacatcagtgtatttctgcttttttacctccctcctcctccctttaaaattcttattggttatcacaggaacaaatttccctccgttgtttcattttgtaaatcaaaaactgccctaatcaccgattacagataaatcataatagtgatctagatctacagagctgtaagttacaacgtgacagcagataaaataaatattctgcttaatcataaaaatacttaaagacattctaatatattttaaagggcccagaaaacttgcagaatctccattaaatttgctgcccacatcctcaaactaaatgcagagatcctcaaatgacatgatttgattatattttagatacttcatattgacttcatgaacactttagctattcaaaaagactaccattttttaatggaaatgtacagcatttcagctaagtcacattaaagtgactttatgggttagcatgagaacttaatcactatttttaatataattttgagggtaaaatattaaactgactcctcctgtttgcagggctgggaactctcacacatccaaatcctgaaatgccccagagagcctagtcagtggcctggccagcgagacagggacccagcatccttccctttgagctgtctggcagcaagtcctacccacagtgaaacaggaactggactgagaaatcaaactggctctagctaaaggacaagcagtctcgttgcaagtccagagcccagcacacaccattctgagccagtgaggtcaagacttccttgttacagatgctctcctggctgtttaatcatgcaatgacatcaatccagagtaggaagggtgctggctttaaggcacagacgcaggctacaccatacaaaccagatgcattgctgttgaccactcccacaggcatgcccttcaacaaccatccagttataattacctgccagaggggcccagaggatagcggaagtgaaggacacctgaagtgggaatgtacgtcaaagggaaaacactgtttgacttctaggtattccataagcacaaattttcaggactgtactgaaaggacagcgtgtaattagggacggatgctgtatggaatggtccaaatgccatctggtttaccatggtttcagacttcaaccagtgcatcctagggcagtggaatacaaatggtgaattgcgtttagagattttatccttaggaatgtggccatcacacatcacactgtgttggtgatccactggaaatggcaaaaggaaagactggatctggcttccactcttcagtcagacctcagcctgaacctgaccttggcatccgacctgggcacctttcagggtgagcatttggtggcttaactaggactaaaggtcccgagagcgctgctgtaaagatacttgctcatttgcaagctgctgggaccctgagttcccctgaaatagatgacgatagaaaaagtctcccgagatgatctggaaagggctgctcatgccagcattatgtgttcacgtctagccaggcaacaccgcctgacacaagctgttaagacgccagcactaagtgtgggctctgtcactggcttgactgaaacgttcttagggaaagttgcaacaagagcatatgcacacgttaaacgagagcttccctagatcacaattaacaaagccaattttccaagaaaacggctgaaggtgatgagagtggcttttttaggtgcttgcccagtgtgaagacggtcaattctcagctcttctctctgcacccaaggcacggcccctgtcgtactcatgtgaccaggtaaacctcaggcacccaggtgggtctccctaggccgagaagactgcctgctcttttattttgtactaaagactggaaaggaaatacattaaactgtgcttttctttacaccaggggcggccaaaccagccagtgggccaaacctggggtgctacctgttctgtaagtaaagttgtactggaacaaaggacagccatttatttactcacggtctaaggctgctttcacgctatcacggtggagctcagcagcattaacagagacacgcaaagcctaggctatttactgttggccttttacaaaagaagtttttctgacctgtctacagggaaaatatatcttaaatatgtgaagaggcagtgggtttctgcagctagaaattctcacagttaatagtggtcactagacattagtttaaaaaacaaaatcctgagcagaccagcaactttgacatgacgagatcccatgtcgggctccagcctcaggacagcaggagaacctaagcaaactcccacagtccttactttattcaaaaccctgccagaggccccccatgtccagcttggtgcccaggtaacctgaaccccactcccagcctggtatctctcaccagctccttcatacgagttcatctttcatttgtcatttaaggcacagagaaaatatcacctcctccagcaaatattccaggatctcctttgaatctgtaatgtgttcccctacaacttaggactttttgtcaagatttctgcaagtcacctcccaagttaccaggaagctgcttcaggattctctgggagtgctggttaaatgtggagatttctgcatctcgtcctggttagccagattcaggggtgggtggcaccaaatctgcattttcaacaatgccttctagaggtggctgagactgacaacccctgtgccaggttaagggatttatcattttgtcacctgataaatgattcttggatatctgcttgacaccagcacaattataagcagatacgacgatggaaaacacttcctgagcccttctgtttctgctgcgtgaagaagacactaatcatggtcacatataaggggccgtgatgtgacggtgtgaaatgctgtgggactctgcaggtgcagtcgcttgagcgagtcttaaagaacgagaagtgcttcgccacgtgtgtgggggattatgggtattccgggcagagagaggggaggtgcaaaacaagagccacaggacggacccaggaaccctcagaggactgcagattctccacttgagcgaaagcacagggagctcatatgatgaaggtcagtggggaccagatgacaaatgccccgcattcttcctgcagcaagagggaaatgagtgaaggacctgctctgaaaggaccaccgtaggagaactgggagaggtgaccttaaccctgaagctattctcagtcttgaaggaaccaagccacagaggacatcccaataggctgtggcatggctctgtgtgtcatctttgctttttaattccctttggcatccgctcacatgacgagccagcctgaatcagatctccgcctgtgtccagcctctatctgctcccttcctcgggctgctgctgtctgtgctggtgcactccccacaagctgtcctgcccatctcaaccttgaggcgggcatcccccgatactaggaagtggactggcttcacccaccatcttgacccaccatgtatcctcagcaccaatgaatacttaatgaaatgaaggagctatttatattctcagaaaggacttctattaaactaaaaataagaggttaagtctttgtggcaagttggttttgactgcacatttggaagagagtggtgattagattaaaagtactcagagttgggggtgaaatgtgcatgggttttcatgattcaaccagataagcctccagatgccgggcggcttgcagtcctcctctggtgccatcagagaaactttaaaagccaatggttcctatgggaaacaccatgaagatacaaaatgtatctgcccagaactaaactgttaatgaaaatgaataaaacaaaaacaaaattcaccaacacagagcatatatactctgtgcctggcttccttcatctaccaagacaacaaccaaagttggtacaaaaccctgcattgtcaaatgaacactcaagagtctaaactgcaggaaaaatttttgaaaaataatccttaagagatgtaacaggtttggctttgaggagccataggttctttattgaatctaccactaggagtgtgtgtaccaactacttttaaagaaaagcaaggccaggcgtggtggctcatgcctgtaatcccagtacttcgggaggccaaggcaggaggataacctgaggtcatgagttcgagaccagcctggccaacatggagaaaccccatctctactaaaaacacaaaaactagccaggcatggtggcaggtacctatatcccagctacttgggaggctgaggcagaggaatctcttgaacccggaaggtggaggttgcaagtgagcctagatcacaccactgcactccagtctgggcaacagagcgagactccatctcaaaaaaaaaagaaagacataatgtgtcaaagaaaactttttcttaattgatgacatgttctatcatttactgtatccatccatccatccatccatcgacctgctgaacttttggaaagcagcctgcactgttctatctattcgtggtgatggtgatgtgattgtacacatgggtataagctcatctaactatacagcttaagggtgaattctgctgcatatctattgcccctcgacagagctgacattttaaaaacctatgtctatcaatctaacaagtgttttcagggagtggggacttaggaggatgggggtagcagaggcagggagatgacaacacattccttaaaacaccagagtcatgccaaatattgaaaaaactccccaaatttaaaacaggaaaagagcttccatccttatttggtgataagtactgttcactcctgtgtagagctgcttttgccagggcagtcacctgcctaaaaaggaagaatgggggttaggggaggggaggtaggggaagcagaaggccatgaggaggaggatgagcaattcagagcccagggaaatgtttggggcaagaaggacctgacagttgaagaagaaaggttgtagaaaaccaaattcattaaactttcatgtaacaagaggactcaatcagactcccaggcccttgaaacatcacaaataccagctaacagaggaagggtggagtaactgaagggagaccacccagaaaagctagagttgcaggaacaaaagcgagtagacccgccttagagaacaagcttggctgaggcaagagggtctccggcctcaggaggggctggatcaaatgcccttacagctttctgatggcctctgccatagattccagggtcagtggggcccaccctggctggggacactggcagtgtggccaaccccaagccctgctacactcatcaggtctgcgttgctacacaaggctgtccagcccttgctcgctgtgcacccgctgcactacctgcctccttccctcccagtggggaaaactaagataaacagagtcagccactgagtgtggacaggtaccaggcatcagctcacctgatgctcgctaacaatctttcttttgagacagggtatcgctctgtcactcaggctggagtgtagtggcgcaaatcacagctcactgtagccttgacctcctgggcttaagcaattctcccacctcagcctcccgagaagctgggaccacaggtgtgcaccaccacacctggctaatttttttttatgtttttgtagagacaaggtctccttatgttgcccaggctggtcttgaacttcggggctcaagtgatcctcccactttggcctcccaaagtgctgggaatgcaggcatgagccatggtgtcctgctcactaacagtcttatggttagtttaccattgaggaaacagggcttggagagagcttgtccaaagtcacgtgactattaaatgatggaaagggagcccagccgcctctgcatccaaggactcagtgcagctggcagtggggacagggcagagacccttagccaaggtcatcacctccacgttctcactggtctaccttatctcggctcactgcaacctctgcctctcgggttcaagggattgtccttgcctcagcctcccgagtacctgggatataggcacccaccaccatgcccagctaatttctgtacttttagtagagatgaggtttcaccatgttggccaagctgatctccaactcctgacctcaggtgatccgcccgcctcagcctcccaaagtgctgggattacaggcatgagccaccgtgcccagcctggtctcccatattaatgtatgattttaaattcctttttagttaagtggatggtaacaaatttttttatttgggcacaaaaccctataatctgccattatgtgcctgcttgacatgacaaaatacaaaggatttgacatcacctacacagtaattttggcaacaatgtttaccctaaatcaaccatgcctccagccccatcttctggttgacaacaaatcagagggattgtgggacaaatcaaacaatatgacagggacacaatcaagacaaaatcagacacgagacaccaggtctggaatctttttaaaaagatgatgacgtggggaggaaaaaggtggagacagcaaagagacacaacaaacaaatgcaccacacgaaggagactggtttagagagggaataatggggaaaggtattttaggaacaactgggaagttaaatacgaactgcatatgagatgatgaaacagaatgattgttaatgttcttaggtgtgacaaatggtctcctgtgatacacaagagacaccgtcattgctaggagagtatgtaggggtgagccatcatgctatctgcaactttactttttttttttttagacaggatctcgctctgtctcccaggctggaatgcagtggcgtgatcatggctcagtgaagcctcatctcctgggctcaagcgaccctcccacttcagcctctcaagtagctgggaccacaggtgcacgccaccacacccagctaattatttttattatttgtagagacaaggtctcactatgttgtccaggctggtctcaaactcctgggcttaagcaatcctcccgcctcagactcccaaagtgctgggattacagccctgaaccgccttgctcagcctgcaactttactttcaagtggctcaaaaatcaaaaaaattacacttgtaccccaacatacatatacagaaagagaagtggggtctctcccttgccccaatctgatcaccgcatccctccatgcttctaagttttataaacaatcatgagttcgaagtccccagatttaagaccttcaagtctcctggagccaccccttgtactcaatgagcacatatcatggacaaggttccattacgggccccaggaacctgacaggatagaagacagaggaactctctctccttagggcagacaatctggttagaggccaggttcctaaaccagctacaatgactctcttggccaaaccctaccttttctcagcacatgaacatgctgtgtgcctacagcaggcctgagaacggccaggagggctctctcagagggggcatcctacctttcattttgctggagaggtcagagtgatgcttctaagaggggcctggagtgaaaggctgagggtggccccacagatgccgtaagactctcctcccaccagcctgcgggaaagtcagtgtggtgacggcggggcagggtcttggagggccctagagacaccaagggtcaggggtgggaactctgggaagctcagaggtgccacaaaagaatgacggctgcaggctggctaggggactctcaaaaccctgacctgatttctctggattttaaaggctttgtactaattcccggaacaagggttagctggaattgacatcacagaccaaccagaatgagaactgttgaaacctcgctcaggggaaaactcggtaatgaagacctccttgacacaaagctcaggggatcaaggtcaaaggagaggagggaggaggaaaaggtagggaggaagagggagagggagagggaatgccatgaggaagggccgtgaggaagctgcctttccctaagcaaaggcttggaaagcaccaaagcctcctaaagtcctcaacaactggggctaaggcccacaacctccaatgcaaaaagacaacggcccctggaagaaaaggaaaactttcatgccaggggagagatgtgcagtgaaggaagaagggtctgcagcctgcacaactcagacatgcttcacgtggtctcagccagtcagccttgggaaatgtacccccatgctgtggcatctacaatcggcctcctgttcttactctgctcaaactgcttcccaagccagcagggaggggaaccatgctgcctgctgacctgggtagttctatttaggtcttgtgacacaacagtgggcaaggtgatgccctctgtgaccaaaagtatttaccccaagttcccccaggccctccctttcgtctgcaaagacacacatctgtttcactgtgtcttctgcaaagacacacatctgtttcactgtgtcttctgcaaagacacacatctgtttcaccttcatgggtttcccatcaactctgatcatttttatagaatgaaacaggtttccaggatagcattccactcagatcaagagcccatgtgaaatgagggggacgacttgaccacagcaccttgttccttcctgtaatctagacacttctgcacaatagagggcccacccctcaagggcacaggccatggtttgtcctcaggctcccttcacccacaacatccagcgtgacagaaatactgggtactcagcaagaggcagtcaaatgcacaatgcaggatacagaaccgaaacacaacaggggaaccacttcggagctggagaagtctgacactgtgtcttagaaatcacgaaagctggacacgaaaaacttttccttctgctgccctaagcctaaggaaatgagtggtgagcttctccaaagcaaaaacacaacccaaaaaagcccacagaggccatctgccatccttccggcagtgctgctgggagtcaggcctgcacgcccggctgcatctgcctttcctctccaccttgctccctgctcacagtctctctaccccaactgcagaaaataaacacagaagtctaaaagaaatgataattcacagcctatgatggatctatctaagcaactagcagaactaaaagtctaaaatatgagttcacattttcatatgcaaaaactcccaaaaagtattttaggaaacataataatctacaaaaacacaatagattcattaaaattaggcgaaatatatcattcccaggacacctgagggagaagccttctttcattttcacaaaggaaacggggctcgaggggtcacttgtccaaggtcataatgccacatgctgtaaacatatctctatcctcagaaatgtaggtttgatacccaaggggttagaattccataaaagtatcccaaaatctgactttcacttgcaatggccatgcgtccagctctggcagtattgatcttggtgagcacccctagaacagatgctgtcctgagtgagatctgggtgtccaagtaccagagggggcctcaccctactgaggtctggctgccaaccttgctctgctggatgggaacagcgcatatgctcacggaggagttggccatttggggatttctgctcttccctcactaaccccacaggaaacctgaggcaaggctgtgagaggtggtgcggctgacaaggtagcctggcctcgtctggcctagcgcaaagatgggaacaggaagggtggaggagtctgcatcccaacaggaagggatggagggtggagagacgtgggggggatgagagaagaggagacacacgaacatggggtgcagcaaacgtgccccccacggtgactggccagtcaaggggggaaccagcggcctctctcgttgcctcagtgccccttcgctgcctcagacacgcagccccctgcacagcaggcccccaagtgtgctaaggacccacacggaagaaggtctgcagacagggtctgaggccgtgcggagcaggagcccccaccggagccccagctcactgcccacctgctggtcggagaggaagcaaggggtgcaggcaacacacagcactgcaggctcagattcacagcaaaagcccccctcagcctgggaggcccagactgcccacaaggtgctggcaggggcgctcccctcccccatcccaaaggctctctctaagccgctccactggaaagattctttaatcaggacacatgaagcacattccattccgtgctgcttctctttccagctaaggattcaaagcaggaagggacccccaggacgagaaagagtgagactggggaatgagttcagtcctagcacagtcaccttcctatcccacacccctgaggcttgcctaggcccccatcacctttctcatggatgtcactgatcccctgggatggtcctcaccccctatactaagtaaccaagtaacgtccttcaaggcacagccccgggggcgagtcccctgctaacaaagccattgaatgctccctgtgcctgttgataagtcccaagctctggcctctgtgtgcctgggcagggggatcatgccaggctgtgacttcctgcctttgctcctgcccctgctgggatggaagctgctccctcagccctcctgggcagagcccttggagcctgcagggcctgtctcaaacaccacctcctccagggctcccaccaagtcccctggaggatgcactgtgtctccctgatggcgctgcccttcgtgctgcaagccatgtgcttcgatgtcaccattgcgccccacaatggccaggccccgcacctgccacatagaccagtcactgaatatctgcagggctgagccagtactctttctctttgcccaggttaagagaacgggcaccacccacaccccgacaaccatagaaaacccctatcacaagcccaacaccccaccaaagtccccagcacacctgcacctgcccagcagcacacagttgctgacgtgattagagtcagcaccacctgatttatgactaagcaaatggccacactgtggggaggatggaagcaggggtggggctgccattccttgcacagccaaaggtcatgggggactcactctgactcctcacaaacacagcaagaaaggctgctttcacccagccttgtgggcatggggcgcacagacacgcaccctcctccaggccacagctctgcattttgggtccctgagccatcccagtagggtgtcaaatccctctcctgttcttactccgctcaaactgcttcccaggccagcagggaggtgaaccacgctgacccaggtagttctgtttaggtcttgtgccccaacagtgggcaagatgatgccctctgtgaccaaaagtatttaccccaagttcccccaggccctcccttctgtgtcccattagcaactttgcccatcaggctcagctgctggccaggcctggcctccttggcatgagctggggcagagctgcacacggtacacacttcactgcaataaacacagctttcatcccctattcaggtcaaccaataatgctcagctagagacactgaccaaattcacagagggattatgcctacaaatccacggataagtcagcggtttagaaaaagaacatctccccagagaaccagtgctccatgggcaaggtaaggatcctgagtgagccaaaaaaagctctgccgtgcactctggacttgaagcacagagccctgaacactgtacccaaagaatgaaagagggtgctagtcaggttgagcccttcttggaaggcccagaccacatctccttcccctagtcggtcagtgatatccctgccctgccccctggggggtttgaggagaccctcctcccttcagcccagcttggtggttgtgggcagactagcaagggctgggatctgggaaccatcagagcttgccagccccaaagcctttagtccacatagcttctttccatcagcagacctgcagcctaccctcccagggtgtggcctatcctggcaaccagaacacctgcacatggctcaccgccctccaaggctcccctatccccgtgccgcgttagggcaaccctgaggtcccgaaggattctgactcatcagaatgcagtccctgacttcagctcacacccacctcccaccgcagggagggccaggccttactcagcctgtctctgacagagcaagagacagctggccgtgaacttaggacagtcctgccagagcaggctccacttcctgagcagtgccctggggtaaagcaagaggctgcactgcgaagaggggagaggagcaggaaaggagaggaaaagacaagcttgcaggaggaggtaggaaggtagataaggatgtttctcttccttcctgtgccagctccacgtccatttaagctggtggctggaaatgcagaagtgaacaagccaaagccctggcatcaaggaggaagcaccgtgggaaaaagacatagaaacaaaaaggacaaactggaataaaggccacactggaaggatgaaaacaaggtgggaattcagagaacaatgaagggctccacagagtcgggagggcaggacaagctgggcctggaggatgagctgttgtgtgccaggcgggttgagggaagacacacaagaaggtagacagcgggcccttgggagtgaggccagggaaggcaggagacagggctcagaggcatggctggagatggaagtggggcagagagcaagggcaagcctaaatgctgggtgcagcctggtgtgtaaaaagggaggagagctgcagtgtggctcaccctgaggagggtgtggaagtagaaagatggcactgggtgtggggcacaaagtgagtccaagagcagtgccctggaggcagggaagccaacggggagcctggtgggacactctggtctgaacgtaaggaataggggcacagaggggtgctggggagcgagcatgacttgccaagggggcaggggaaggagagtgaggctgagtttccagcttggacaactgggtaggggaaggtggcggtggtgccattcaccaagagaggaaatgactgggaggaacactgaggggtggggaccaacggccactaggacattcccgtgcctccattctgtccttgccaacagccctaggcaaacggcgcagctcaatgccttctgcgctcaatgccttctgggggctttggcatcccccattagtaccccaatctcacctgcatccaaacgttgtctgtagcaaagtagtgattcccacacagaagaaaatggtcccaatgagctggctggtggcccactggtcgtaccccacacacatggcatcggccaacaggaagggcactgcgatcgtgccgctgaagcatgtcaggtagtgctgtgggcaggaaaagggtcagaggagaaacagtaaacccttcctcatttattcttgatttcatcctaattcttctctcttattgtcgttaaaaaatagcccacataaagaatctccttggtttttcgaccaagccatacttttttccttctttttcagtatttctcctttgttgttaagacagtttcactcccattgccctcgacggagtgcaatggtgcgatcttggctcactgtgacctccacctcccaggctcaagcaattctcctgcttcaacctcccaaatagctgggattacaggggcgcaccaccacgcccagcttatttttgtattttttgtagcgatgggttttcaccgtgttggcaaagctggtgtcaaacacctgggctcaagcgatccgcctgcctctccctctccaaagtgctgggattacaggcgtgagccaccacgcccagctgcatttctccttttcattacattttattgtcttactattcactgtcattattacttattacttggatgaatccatgcctcacaaaggaaacagtcaatatcagcactggtgatattttacttatgtaattcttattagaaatatttgggtttcttccccaaaatgcttttctggcataaattgctaaaaccataaggcctttctcctctaatctgttatcatgaattgtgatgtgctgaactattcttgcatgcttgaaacaaaccctagttagtcatactgtatttttcttctgggatttgatttgctaatattttatacagaattttgcatctacatttctaggttaattagtctatttctttaaaaaagttctttcatgtctggggattaaagttacataagcttcataagttacatacgcatggagtgttttctgtctttttctgtgagctggcattgttttcgaaaacaaagaattcgtctgttccagtcagggcagggttaagggcgtacagtagccatgggaatcttccagaaagaaccccatcccactttcctttgggagtccccccaaccccccgccacacctgtagccctggtaggatagtcccagcactcacgactcacttccctcccttcccctgttgaccagttcttatttctgttctgcaaacttcctacttttcttccagcagcttcccattcctgcccacgttagccaaacatgccacatgcagcccatgaagcccgactgtaaaggagtttcctggggtgaaatactcctgttcaggatgtctcagggctgctcacaactttatgtactctgaatcgtcaggaagggcatgatgcaggcagggtttcccactcctatctgaccagggaagactgctgggaacatttataagataaacattccaaaaagtgtccttcctgaatctggttcagaatgctcagcccaaggtagactagttgccgaggccactcagctccttttgctctgactcctcccctactcaacagacacctgccagtcggggttaccatgggctgtgatacctgaaacggggtgagggaagggcggggcaactggaaactcaaccaaagtacccagctgttggcagccccaccccagggtgaatcaacctctctggacaatgagatggattttctcggcacctgagataccttaggttgaactgaccacacaaacttgagaagggaaaaatgctaagtccgacctcagaacagagtccaagttaaaaccaaagcatattcagtccaggagtgtgcatttaagaaaagaccctccccacgttgtcccctttctccaaaacgtcccgcgttcatcctatgaaagggaaaagggtgctgaagacagaggagggaagtatcaaagacgccggaggcctccatcagctatgtcaccacccaccttgtccctgagcccggctgccctcccctcccactggaagctgcagcagacaaagctgctgctaccatggcaagtttcccttcctttaaaaaataagactgaaaacctaccatttaggtcctggccaacatggcacttttccgggtagctcctgtttcatggcagaggttaccatgattgtgggtgggttaactaggccaggaatgggagatgaaaattaatttctcttttctctattcttcaacttttctcctttctctattcttccttctttctataactctatttcctttcccttcctttatgtcactgctcttgcttgtgccctgaacatcttctttcttttccctggtaatccattctacctgttcttttcttcctcctgctgtgatgtcaacaattcccattcatcatttgttttttgagacagggtctcactatgtcaaccaggctgaagtggagtggtgtgatcacagctcactgcaacctcaacctcaagcgatcctcctgcctcagcctcttgagtagctgggactgtgggcacacaccaccacacatggctaatttttgtattttttgtagagatggacttttgccatgttacccaggctggtcttgagctcctaggctccagtgatctgcccacctcagcctccaaaactgctaggattacaggcatcagccactgtgctcagcccctactcatcactcttaaaagaggaatttataaaagtcttcaataaacaaaaaccaaagtggaatttttaaacaattccagatggtagacaatgcaaacacctgctggtagttacacatcctacaggaaccatcttacctgtagccccagaaatatacacaggtaccagggaggaacatcttctatggtataaatcatgtctgatcgctgggggtccagactgccagtgctatccagggtctcagcgagagagctctgcgagccagaaggagaaaagaaggtgctcattaaacgtgaagaccagtgttagctcggccatgtacaggccactattacagaaaaacaactttatcaagtggttgccatcttcctgcagttttgagccttggctatctttgaagccaagtattctctttggctcaagtacagtcgcccaccgggatggtcaatcctcagaatttggggggtcagcgtccttgggcaacatctcatccctgagaacaccaaacttgctcagagcttctccccaggcctggggatcctcctgcatggacagagatgttcccaggttgagaccacaaaatgataccttggcacgagcagtccttgcgtgagaccccagatgaaaaaaatcttagaaaattttaaccactttcaaagagacagcacactgatctgcccctcccagcccacttcatccctgcaagtaaaaaggatctttgtactttaaaattctacaccctcctatccaaacactattgctcagataacgttaggtgaaaagagtaattctaaagtatataaacacggtgatttgaattctgtttaaaaaacaaaacattaaaaatgtattcatagtttaggtgacaggttttttcttctttttctcctaacactagtaaaaaaaatattttaaaacattaagtgtggcatggttttttaagcaaaaatcatcataaagaccagtcactttaggttagagtccagcctcttccaatcacccccagcatcagttctgaactcatgcagtatctgagccaaacagaaaactcaaggtagccccgagttccccaggagaacctcaaaactgctctggtttcaaacaccacacaaataatctttccttggaatttctacaatcatttcttggaatccaagatatgtatctcattttaagaaatgttttataacctagcaaacaaagtgtttaacaggaaacaaaatgaagagatatccacatggaaaaatgctgattccatgtgttccacccacatggaggcaacaggggtttggggtttggggcccaatacccttaaacaaaagaagggacacagttcaccctcacctttcacagccagaaggtaaatgtctgatggaagctgacatctcatctaatccaaatgtaactgaatatgaccttttgggtaaaactttctcttccgtcctaacaagggatactggcaaatttacattgtgttgaatttgttacaatggattatggatgtctttaaaaacttgttgggagaaatggtagaaaaagtacgtatgtgtctgaggggtgtagcatgtagtgatgtacaataaagattaactcagcaggtctgggttgtccaaaccccgcacatttcaaagaaagggttgagtcttgcctggtacgtgggggataacctgagctcttggggtttctgcctcttaaacatgtctttttaggcccagtgcagtggctcacacctgtggtcccagcaccatgggatgctaaggtgtgaggatcacttgaggccagggttcaagaacagcctgggcaacatagtgaggcctcttctctagtttatacatatttttttacctgaaacttggccacacagtgtcagcttgacctctggaggggctggtgagtaattaaagttagccacataggcagtcagccatacctatacgacagatccccaattaaaaaccctggacaccaaggcttggatgagcttccctggctgaatgggtgttatcacatatcactgctgggaaaactgaacactgcctgcatgactccactgggagaggatggctgcaagcctgtgcctggtgtctcctagaccctgcctatgtgcctttttccattgttgattttaatctgtatcctttctctgaagaaaaaaacaaacaaaaaaaaaacccttaactgtgagtaaaacagctctgctgaattctctgagtctttctcataaatcacagaacctgatttgggaacttctgaactgagggcaccattttgctaacgtgatggaattacagacctggggctcactacacaaaggtcagctcaacagcaccgcgtcagctacagccacacaggtggtgctgctgctcacaaagtaacatgacaaagtatttcataacaaagagaaatgtctgaagacagaatacataaccctatcatagactagtacaacctgttatacagtaatgtaagcaacatttttctaacaattccaaaaccactagtgttaattataaggcagatgaaaagactttttggctaggtgcagtggctcacatctgtaattccagcacctgccaaggcaggtagatcacctgaggtcaggagttcaagattagcctagccaacatggtgaaaccctgtctctactaaaaatacaaaaattagctgggcgtggtggcgtgcacctgtaatcccagctattccggaggctgaggcaggagaattgcttgaacctaggagacagaggttgcagtaagccaagatcacaccactgcactctggcctgggcaacagagagagattctgtcacaaaaaaaaaaaaaaaaaaaaaagcaagacttttcgcatccaggcagaggttaagatgtacacacaggcgcatgtatgcacatgcacacacacaagcttttcttagtaatgagggtagccctacaactcagaaacaaaactagtgtaaaggtccacaactggtactaaaatgatacaggagggggctgtgtggtcaagaggatcagacaacactgtgaggcagacgctgtgccccccctcctgatgacagaaggaccactctggccattgtgcactctacgcactgtggcgccacactcagtgatcactgtaaactatgagctattttaaatactgcaaaaacaaaaacctctaataaggtttctgtaaaagatgactacataaataattacgtcactttacaaagactttccatcttattctatggtccaaaataatctaaagaacaaaaaaactgcctgtgctccaaagactagagtgaactcagaacgctgttctctgcctggagccttcttaacatttttaataacctttgctatctcctctgcggttatttatctagtctagcacctttggggtcgattgtagtctctttctctaggaaatcatttcttctgcagcacagtcagcacatattttttataaaggaccatacagtaaatatttcaagctttgggagccacatggttctgtcactgtagcatggatgcagccttaggcaataggtaaacaaagaaatgtggctgtgttccagcaaaactctactgagaagaacagatattaaaccaaatttggcttgccaacccccgctgtagcgtttcaaactgattatcataaagtagcatgtattattctcttgtacatttctcctttttactatactaatgtatatgtgtgctttctattttttttctcttgatcagggccacaacagatcagttttggccaggcatggtggctcatgtctataattccagcactttgggagaccaaggtcggcagactgcttgagctcaggagttcgagaccagtctgggcaacagacagagaccctgtctccaaaaacaaacaaacaaaaattagctgggtgtggtggcacatgccagtgatcacccgctcaggagtctgaggtaggagcatcacttgagcctgagaggttgcggctgcagtgagctgtgatcatgccactgcactccagcctaggcaacagagatcttgtctcaaaaaaaacagaacaggctggtagctcacgtctgtaatcccagcactttgggaggccaaggcaggccaatcacttgaggtcagcctggccaacatggtgaaaccctgaaaccctgtctctactgaaaatacaaaaattggctgggtgtggtggcgtacacctgtagtcccagctacttgggaggctgaggcaggagaatcgcttcaacccaggaggcagaggctgcagtgagccaagatcgtgccactgcactccagcctgggtgacagagtgacactctgtctcaaaaaaacaaaacaaaacaacaaaaaaccaaaaaacaaaaaacccaaaaagatcaatttcattattcttttcaacaagccagcttttgagttctagttaagcatggtagattgaccacatgtgtcttttcttctaagtcctaaaaacaggaggaataaatatgatactcatcaacaaggacaaagcaaagaggagatcaagaaaaagagattaatattttttttaatatggaaattgtttggatgatttgtgaccaatttgggagagggaaggaatgcacaagctgggtgctcatagaaggatgctgtgaagaggtgggctggctgaccagcaggaccccagaaagtgctatgcttggaagcactagacagagtagcaatggggagaggacaggtcttaactccgcaaactggtcagacagtgtgttaactactgctatcctcctccttcaagaaacaaatatgtatggtttgaagaatataaattggaaagccctcaggctgaggaataccacacagcgatcaaggaaaacagcagcagcaggatactcatctgcttccagaatgccagaaaccaggtcacagaagccagacttatacccacaggagaccacacgattcctttctagagaaagttgatcagccccaaagacaagatagtgacatctatagatcccacagagacaacacggctttccacctggtcactcaagggcaggcccacgattagataaacttcatcacacacaaagacctcacaatcctatcttttattgcctcctatcctggaacagtgaagaaagactaaaaaaatgaaggcaaagaaacagaaaatataatcaatgtagtattttttaaaaagcttaaaaaaaaactatcttcagaaaaataaagttacttcaattgtgggagacaaagaatgctttttaaagactttaaccagtaaacaaaaccaaaaaacaataaaagaggtctcagaaattaagcacaggatagttttttaaaactcaacagaagggctggaagtcaaaggtagctctcaaaaataagaaaaagacaaatataggtaagagttaagtgttaaatgtcagaacaaggaaaaaagaatatagaaattaaccaaagaaataagaaaaatttaagaaataaaggacatgttaacaaattagaaggatactacagtattcaatggattaatgaaaaaatgcattttgaaaataaaacaatcattcttactaaggaaggccttaaaattcaaacagacatttaagggaaactggaaataaacatgagtttacataatttggccagatggaaaggaaaaaaaatacaaaaaactatgaaagtgtgaggagcacaaggaagaacagataagctgcaaaacagagtaagtgtcagagactagaatgaaaaagctccgtgctaagaggaaaaaaaagattaaagagaactgatagctggaggaggcaggcaaagaacaaacaaaacatgcataattgcagctcccaaatcagaaaccaaaagaatagactggaattaatatttaaagatacaattcctgagataatagcagcctcaaagctaaatattgaaaatgccaggaaaaactggcccagaaaaggatatacacatgggtcttgagcatgtgtaaagagatgcagcctcactaatgaaaaatcaggataaaactacagtgacgaacctaagctgagagagattctacaaagtaaactggcttgtaccatgttacattaacaacgaaaaattgttccagattaaaggagactaaagatatacctaaaaagtaaatgcctcaacagcccctgatttgattcctggaccaaaacttttaaaattaattaacttatttatttattttacaataatgaacattatttggacaactgaggaaatgtgaataaagcttgtagatattaaatattttaaaattgggattaagtaataaaatcaattaggtattgtatgactaataatttaattcatcagtgttaagaattgtactgtagggaccgggtgtggtggctcatgcctgtaatcccagcactttgggaggccgaagcaggtagattccttgaagccagagttccaggccagcctggtcaacatggcaaaaccccgtctctactaaaaatagaaaaattagccaggtgtggtggtgcacgcctgtgatcccagctacttgggaggctcaggctgaggtatgagaattgcttgaaactggggggcggaggttgcagtgagctgagattgtgccactgcattccagcctgaatgacagagcaagactatctcaaaaaacattgtactgaagttataaaacaaagagaatgtctttgttttaaggaaatacacatgcagtattttccctaaataaagaggcattatgtctgtgagatttgaacagctcaaaaataataatatgcctacaagaaggatgaagaaaatacagtaaaatgttaacatctggggcatctgtttgtgtgtacctatgtggaaagtggtatggaatatacatacaggttgaaaatgcttggaacccaaatgttttggatttcagatttttttgggattttgaaatacttactggttgcgcatcacaatcccaaaactcaaatccaaaatgctccaatgagcaagcatttcctttgagcatcatgtcggtgctcaaaaaatttcagatattggaacattgcagatttcagatctcagttttaggacggttactctacatcaggttgccagccgctggttacgtagaatatataaagaacgtagggggcacattttcaactttctccattttttggactgtttactattagacaatcatgttaaaatgaatgtcattttttttttggaacaactagtcctttaacaaaagatagcttaaagagaatccacagggatcaagtcagaaaaggtctcttttgttttgagacagtctcactttgtcactcaggttggagtgcagtagtgctatcttggctcactacaacctctgcctcctggattcaagcaattctcttgcctcagcctcccaagtagctgggattacaggcgaatgtcatgaagcccggctaaatttttttgtatttttagtagagacggggtttcaccatgttgcccaggctagtctcaaactcctgagctcaggcaatccacccaccttggcctcccaaagtgctggcattacatgcatgagccacccacctggaccaagtcagaaaaggtctctaacaaaaaaaagtagatctcaaagttacagaagacaagtttattttatcttgtatttaatatgataattgcaactaagcatttgaaacaacgggcagcaaaaggcccagtggcacacagggcagcacatccagtgcaggctctttaataaccagcttacatgccactctgctcacactggggcaatccggcttcctgagagccttccactacttttggccgggtatggtggctcacgcctgtaatctgagcactttgggaggccaaggcggataaatcacctgaggtcaggagtttgagaccagcctgaccaacatggtaaatccccaactttactaaaaatacaaaaaaaaattagcctggtatgatggcgtgcgcctctggtcccagctactcaggaggctgaggtaggagaatcgcttgaaccagggaggcagagattgtagcgagcagagactgggccactccacttcagcctgggtgacagagtgagactctgtctcaagaaaaaaaaaaaaaaacagcccgctgagggtctggcttaatgactagcattttatttatttactttttttgagacagagtctcactctgtcatacaggctggagggcagtggtgccatctcagctcactgcaacctctgcctcctgggttcaggtgattctcctgcctcagcctcccaaatagctgcaacccaaccacaggcgtgtgacacccctcctggctaatttttgtgtctttagtagagacggggtttcgccatgttggccaggctggtcttgaactcctgacctcaagtgatccacccatctcggcctcccaaagtgctgtgattgcaggcatgagccaccacgcccagcccaactagcactatttaatatgtagcagctcttctcactgccctcctcatttcataaagtaagaaaaatggccaggaaaatattaagatactccatttcattggtattcaaggaaatacaaatgtatcaatgtttagacaatgaaaaaatgttcacccaaacaggaaaatgaacatctagcataaatgtgctagagacatttttcctacaactggatccctcccatcagtaaaaggtaaagctaagccccaaagtgttaatgctcatcactatttatttctaaagacgatctccagacagagaaggaggaagtctgaaaacatgacagcctggaatcatggcatagaggattatatgtggcccaccaagtctgtgaagaagccctttgttacaagatggaccgtgtgaaagctgcggcccggcagtgtgggatgtgcctcagctgcagaccacaggcaccaatccacatgccaaacaccactgcactaacctttggggagcagcttggaaccccgcacttctggaatttcagtatctctgcctgaatctactttaattaacctccataaaatttataatagctccaagcagcaggaaaataataacaatattggttgagaggcaaaaatgaaatttccatatcccagactggaattttgtttaaaagggcataaaatttggttatttcagaatttcaatacaatttatttgttcttaatcactttagtgattacactgtgaactcaccatgctaatacccaactcaggtactatatttgtatgtgtcaacttctgggtggtctgttattagaatacatagtatacactgtctacagtataatacagtggttccagaatagaatttctcattacataaattgtttagtttcttattatgtcagctgaaaattagtaaattttcatagtataaataaaacctgtgtttaaaatctatcaagtaaaactcaaatgaaagcctcagagctgcgatacaatttggagatatcagattatctaacttctcatatgttagacatcatggcagatacaaagaaaaaaagaaatcgggatatctggacctactttattttatttttatttatgaatttatttatttattttttttagagacagggtcttactctgtcttcccagttggagtacagaagcatgatcttagctcactgtagcctcaaactcttaggctcaagcaattctcctgcccctgagtagctgctactataggcacacatcaccacacctggataattatttctttttttttttttttgtagagacaggatcttgctacgttgcccaggctggtctcaaactcctggcctcaagcaatcttcccgcctcagcctcccaaagtattgggattataggtgtgagccactgagcccagattggagccgctttgggcaactttatcctgacctctatggtcacaaagtctgaccattcaaggagatggaacgaggcacagagcaaaacaaaaataaacaaaaaaaccacaaacacgattctccccaccttagtgtgccatttccattggcacactaaggtgccaaaggtgctacggtcaaaactcaaaggcattttcataggctgcataaaccacttgctgatttcccttattctcttatttactgcacatgtatctgtaacaggcacgatgctaataacttcacatatcatttcattcaatccacaaaacaaccagatgttgacatttttattcccattttagagacagggaactgaggcccagagaacttctataatttcctcagtctgactcatatttgcacccagacctgatgccagacctcaagctcttaaccacttccctctgccatcttggctgaggcctttttaaatacctggatcctcctctatggttctcaccttaaatgccattaaaacaatcaaaaaaaaaaaaaaaaaaaaactagtaacttctattccctatggctcctcctacttcccttatgaagagaacacagccccttgggagtcagagaccaagccccagacgaaggacatgcaagtgtctgaaagggatccggatccagatccggggcagcacttgtgggaggggatggcggtgggagtggggacacggggtgacggaaggggtaccttttctgcaatgccgttttccgtagtgtagatcgccatgagctcagtgtcctcattgtcctgctcaccgctggaggtggcgcctccatttatcaccacctgcagagacaatccacttagaggctgtttcagcgtgaaccacattttcctccccccgaaagccatttgtaattctcctggtgagtgcatgaccaggcatggttttgatggagaaacatactccatgtaccgtatggggaggctgccttagcagaaggctcagccggggagaaaagaaataaaatcccagggcaacctcagcaggggcacccccacatccttcaggggaagggaagtttggctcagaggcccatgctgtttgtggacgaggcccaggctgaacaggtgagagtaccctgagctgcctcggttaagatccctgcccacataaccacctgaggccgacttcctgcacctagaaggggaaatgttctagctggaggaactcaagctttgctgttcacctaagtaaaccagcccactggagaacactcctcggtaaggggccacaccatcgtcccgggttctgccagccagtagcaagagccataaaatatttttactttttagccaaacggttccacttctaggaatctatactggagaacaataatgagaacaaaagctttaacccaaagaaagtaatcactgtttataataacaaataactagtttttgtttttttaggttttgttgttgttgttgttgttgtttcgttttgtttttgagacgatgtcgcgctctgtcgcccaggctggaatgcaatggcgtgatctcggctcactgcaacctccgcctcccaggttcaagcgattctcctgcctcagcctcccgagtagctggaattacaggtgcccaccacaacacctggctaatttttatattattagtagagacggggtttcaccatgttggtcaggctggtctcgaactcctaacctcaggtgatccactcacctcagcctcccaaagtgctgggattataggcatgagccaccacacatggctcaaataactagttataggccactgacacccagaatactacaagggaaaagatttttacacagagtaatatcaaggaaaatgcacatgtaataaatattaaggtaactgtatatatggttaacagtgcaactacatttaaaaactacagatttaaaaagtatattaaaagttcaaattctggcattgtgaaatacactaaaagcaagcagaagacaagtgatggcctaggagaaaatacagtgcagcagatataaaaagggtcagtatcaatatgcgtaaagaacacctcaaaccaataataaaaccaaacgatccaattcatccctgagaggcctaaggaaaaaggatggaaaggaaatgggcaagggctaggaatatatcattcatagaagaaaaacatatatacaataaaacacatgaaaagctgttccatatcattttaaattatggaaataattattaaaattttattttaaaaaaaacaaacttagagggaaacttaaaaaactgaaccaggtattgaccaaggtatgggggagagttactctcctgtgttcttggagagaacatgctcttggtggaatggccttcatggagggaaatttggcaatgggatttaaaacaggtatttctgtggatccagcaattatactcatagaagcttatcctctagaaatatccatgcaggtaatatatatattcaaggttgatcactgctgtaatttatgaaatactgaatacttggggacaacataaatgtccatcaaaaagacacagttacattattatacactcatttagaggagataatcagccattaaaaataataaagcactggacacggtggctcaggactgtaatcctggcactttggaaggctgaggcaggcagatcacctgaggtcgggagttcgagaccagctggccaacacagtgaaaccccgtctctactaaaaatacaaaaataagccaggcatggcgttgcacatctgtagtcccagctactcaggaggctgaggcaggagaactgctggaacatgaaaggtgggggttgcactccagcctgggtgaccgagcaagacatcgactctaaataaatacataaataaataaatagctagctgatgtactaattaaaaaaaaactccaagaaatactgtttttaaaaagttataaaacaataagcctagaattatcccaactgagctaaaaaagaaaattgtaatgaccccaccacttgtctaaaaaggacagaaaagcatacaggaaaatcacaaccagtaggaagggtgctgccttagggacaagaacggcaatagcagacacctttcatctttttactcacaaccctttgtaagtgtttggatcttttatgatcaggatgtatttgtgttatttgtatactgcttttttaaaaatggataatttaaaaaaaaagacatactccaaaatgctaacagtggttgtccttaattggtagggccatttttgccaactttttcccctttttatattttggtcatttcctaaaatgagtaagtacaatttattttgataatagggaagaaatttaagactaaaatcctagcagtacagcttggattgaggaggtccagagagattcccaattcatgtgtttttgtagtcaaggaaatcagggcagtgaaaaattaggtttctcattcaaggtcatacagattataacctaggtctgaagtgggtttttaagtatgccagagaggccaggcgcagtggctcatgcctgtaatcccagcactttgggaggccgtggcaggcagatcacccgagatcacgagttcgagaccagcctggccaacatggcaaaaccccatctctactaaaaatacaaaaattagctgggcgtggtgatgggcgcctctaatcccagctacttgagaggatgaggcaggagaatcgcttgaatccaggaggtggaggttgcagtgagccgagattgtgccactgtactccaccctggtcaacagagcgagactccatctcaacaaataaaaaataaaataaaataaaaataaaaactatgccagagatctcaattaattagtacatactcctacagagcagaattctcttacattacttcaaataaagacctgcttttaaaattatttctcaaacatgttatagttttttacacaagccaactgagtttgtggagctggtttacctataaaaactggctgctgggaggatacacattcctggccaagttcaggtccacgagatgaaactcttaacttacagagagaactgtgctccaagtcatatcgcagcagtgctcaacccactgagaagccaagagcaacacgctctcaggatgaactctcctaaaacacggatcagttactaaatcattagagaaacctagatatgattgaaagtctgactctagccaaactaaccttcacctgcatttatctcgggttgctgcagggaacagcaactttaccagtaaggggtttcctttgcaggagatgaaaatgttttggaaccaaatggacgaggctgtataacactgtgagtgtattaaaatatcactgaattgttcactttaatttcatgttatgcaaacttcacctcgatacattaaaaaaaatcatctgtatacatggcactaagaagatagattttgaaatgagttagcaattcctactgctcccctgacacattccactcactacttatacatacacaaataagtataatgatccccaacttaaatggttaaacttaggattttttgactttacagtggtacaaaagtgatatgtattccgtagaaactgtcaagtacccatacaacccctctgctcttcacttcagtattcaagaaactgcaagagatattcaacacttcaccataaaataggctttgtgttagatgcttttgcctaactacaggctaatgtaagggttctgagcacatgtgaggtaggcggggttaagctatgaattgccagtaggttaggtgtattaaatgcattttaggggtgtaactctgtcataagtcaaggaacatctgtattataaaatgcagacactcctaagcctagaaaaaaagctcacatattcattcattcaacaaattgtggttgtatcccaggcaatgagaatgcagtcctgcctccctgcaggagctcagtccagactgagtgccccgccaaggaattccgctgttacacaggaggcagtcagtagccacaaagaaatgccaagaacaggagtgccacaatcagatgctagcactggacagccattctgggtgcagcaggagagtggatgggtggggtaaaggaatgaccctttggcacacgaggagacaggagctgggcaaaggtgttaacagtggtctgggaaagacagtcagcttcaggagagagcaatgatgtggacttaatgccccctgaagattgtctggatgggagctctgtggtgagtacagcggggagatgccatcacagcacagcagggggcacgggagtaaagtgtccaggctgggtttctcagctgggaagctgggtggatggaggtgccagtcccaaagagactggcaggaggtaggggtggaatgtttgtaagccaattcaaaatgtgtttgacccacagaaatcatccaaaaaaggaaggtttactttgccaggctagtccaggaagtttatttaactgtaaatactactgacctagaaaacctatgatttgcacaggtccagctgtctgtccctggggacctcagagcccagcttccccctgctaccctcctgttgcccagctgagatgtagctctcctctccatgctacccccatcctctaaggaagcctgtaataagacggggacaccagctggaaatgctcttgtctgactggctcgtctctgatctatttacgtgcagggggctgcctaaatagttcttgcctaaatggttcttacagatgaagagttctactggaagtactagtctaccttaccaacattttttcctttggcttattaaaatagatactctaatggcctatttttaatgcaaaatttaattttaaaaatcaaatggtaaaaatcagttcttgaggactgaattttttatgggaaaaggattaaaatgctgatgatagtagcaaagcttcatattttggaacttttaaatattattttaactgggaaataaaacatgtcttgggaagctttctaaacttaataaagtctggttttcttttgggtaactaatagataacagaagaatcttggcatcgttcacctcaggaaattgatcaagtttttataaaaatatcagcagattagtataccccttttgggaacaagatgtcctttcttctccaaaactatcttaaactaaactcgtggccttaagttttgtctcctaaactaacattgtacaatcaatcagctatgaaaggaggttttctctgcctaaccagatgattttgtctccaatatgcaattgcatttgcattgtatttactgagcaacggacacatttccacactcaaagtcaagtcttacacttgtctttttgcttgtgttttatttttactaagctaagacaatggtattaaagtacttatttctaaacagttctcctgagatggtcagaggtgtaggaagcaggagtgacagaagtcattgcctagaggtgtcagtatcacagcagtgccaggcgaaactgacagctgtgtgtgcccacatttctcaagcagaagtgacagtgcatgtgctgcttcgtgacacctgtcaagcggagggcactagcacctgcaaaaccccacacctccaatgagagtgttcagaactcaatttcccacttactatatcgtgtctggccgctaagagaaccactttatactaaaccaatcgctttcagaatagtaataaagttccccaaatttctgctttctattcttttaaaagaaaggtaacacacagttattaatccccctcctcaatgtgtgcacacaccgttatttcctcttgtatccaaatctactccacaattaaaatgtgttttgaatacagaagataatagattcgtgtttcccagcctttactgcaagctcctttactatgaacatgaaaactttccacctactttcaatattattagaaatttcaaaattaaccactatgaaaaataaattcaagtgagtacagtacaacatattctaaacacccaaagcttgtcaatctagattacatcatctcaaaaagatgcagcagccgatagatctaacatgacactagcgaccttgaatctggctgatgccgcaaagcctctaattttgctttcactgcctcttcccacaggatggctcctgtaactccccagtgcaggtgatgctgctggatggctcagcctccaccactcgcctggcccagcctggtcttcttagggctgccttctccagaaggctaaggctgtggcagccagaagcaccccggggattccagctgcatctcacctgtcccccagtagggcgacaagaggagccagaaggagccttacctctccccatgccggcccacagcagagctcgggcgggtgatgtgtctgccaaggtccacactgaaacactctgcagtgtgtgctcctcccacaccccaggcaggtggtgctggtgactgctactgtctgcctggcacatattcatgcctggcactaggttgggcacttcaaacatcttccctgctaggtgaggtttctaagagatgtccctggggatcctgtccccagatggattcaagaacagatcctgaggccacgcagcacattacagcactccacccaaaacggaccgtcctctcccattctttccaggtgctaacacattacagataacaaacccatgtctctaaaatgtaaatatggaagggacacaaacccaacaagaaaagggctaacatcccaacaggaaaataactaaggaaataaacatgcttcttgaacagtaaaaagatgctcaaccttactcataagaagatatacattaaaactatgatgagaggccgggtgcggtggctcacgcctgtaatcccagcactctgggaggccaagacgggtggatcacttgaggtcaggagttcgagaccagcctggccaacatggtgaaaccccatctccactaaaaatacaaaagttagctgggcatggaggctcgcgcctgtaatcctagctacttgggagactgaggcaggagaattgcttgaacctgggaggcagaggttgcaatgagccgagaacatgacactgcactccagcctgggcaacagaacgagactccaccaaactataatgagaaacctctttctacctactaatcgggacaagagcccagtctgaccacatattctgctgccaagcatgcaagaaaacaggcatttacacattgctgacgaaattcctcaacagagggcaatttggtgagtagccccctcagcttaccaaggcacatcccctctgactcaaaaatctcactcttggaaatctatccttcaattacacctgagtgaaacaacttatgtgccaggttattcagggtagtgctatttgtaatagcaaaacattagaaacagtctagatgtctatctgcagtaattaaataaattatggtgtatctataccatggatcactttgcagttataaaaaacaatgaagataatccttatacactgacacaggtatacagaacatcatctgtatatcagaaagtgaaaagagcaagaacggagctacagacacagatctgtagatacagacacttccttctacaacaaaaactgctccccctaaacagagacagagtaaacatccccctatcctagggctatcagtaatgacaggcacagatctggctggtggtgcggctggttctccctctattccctcaaagtgctatcagatccagggatcttctctgtaattgttctgtatgatgcagtatctttgatcaccagtattactccgcaggaataaaggggctagggagaagaataggcacaatgaaagaatataaatggccaaggaatgctggcagaagtgtttggcttcactgaaactcaaaattaaagcaatcagatacaataaggtcaatataaactaggctgttatttattatagcaaagcattagaaacaatccaaagtcccaatgcaagtggaaaagttagatccatgatttgctatatgtcacaattacaagttctgtttctaataacattgagatgccacgatatgatacaaagttaaagtcttcataaagcagattgtgtgttgatgagaattttataaaagaacactcaaatacttgtcttaaatctctggaaagaaatacatcaaggctgggcacagtggctcatgcctgtaatctcagcactttgggagaccaatcacttgagctcagaaattcgagaccagcctaggcaacatggcaaaaccccattcctactaaaaacaacaataacaactagctgggcgtggtggtgcatgcctgtagtcccagctacccaagaggctgaagtgggaggatcacttgagcccaggaggtcaaggctgcaggaagctatgatcatgtcactgcactccagcctgggtgacagagtgagaccctgtctcaaacaacaatcacaaccaaaaaaaaaaaaaaaagaaatacacccaaaatatcagtaaaatattttctgttactaccaaaataacagaaagtggtgtttttctggctagtgagattttaaattatttgttttcctcattttaccattctgcattttctgcagtgaacttatttctcttgtaaatgaagaaagttacacaaataatgaaaaagggacagaaaatacacatatgagaactacaaaaaagaggcagaagaacatatcagcattcttgcttcttccatttcaccccaacaatgtagtttgtaccgtaaaacctagggagaactatggatgcttaaaaacatccattttaagggcaatttaagagggtggggaatgtgacaactgagtgattactgcctcgaaacctccaatatcatatcttcctcctcaagtactttatcaaatcctagcaagaatgaactttttctccaatagaattatgggcttagattatggtaaagaaatcaatctgaaatattttatctctaatcattaaaactaagaagcctgcctacctagcttaggcaaataaaagttagtgggggtggggattaggaatttagaagtggggattcacctagaagaaaggaaatctgaagtagtcctggaagtgcaaaaggcacaggcaggaatagcaatcaggggtcagaagagaccaaggctgtggggcagggagatcacacagaggttgtcacgatgatcccaggaagaactgatgctgacccacagaaagcggagacagcaggatgaaggcagggggatcacatggggtaggaaaggaaggaagcttgtcaactacttctgatgcattcctgtcacagcatttagcaagagcagaacaaacaagaggtcctctaaggccttttccatgaccaagattccataaacctgacctcacagaaattaagaggtgagaggccgggcacagtggctcacgcctttatcccagcactttgggaggccgaggcaggaggatcacttgaggtcagaagtttgagaccatcctggccaacatggtaaaatccagtctctaccaaaaaatacgaaaattagctgggcatggtcgtgcatgcctgtagtcccagctagctacttgggaggctgaggcacaagaactgcttgaacccgggaggcagaggctgcagtgagccaagatcacgccactgcactccagcctgggtgacagcaagaccgtgtctttaaaaaaaaaaaagcacacacacacacacacacaagtaagagatggccagaatgctgatcaacttcgtaagcctgctatagtaagagactgtagcaagaacctcttactattttcattcgtaacaaattgtgtgtctcccaactattagatgtgtactttgtattactaacatctctcatttcatttaaaactaccaaaactctgttcaaattaaaagtatattgcaatatgataaacttatctgaaacctcaaaaccagaggaaaaaaaattaatttttaagttaaaaatctaggactgggtgtggtggcttatgcctgtaatcccagcactttgggaggccaaggtgggaagactgcttgagcccaggagttcgagaccagcctgggcaatgtagcgagaccccatcttgaagggagggaggcagggagggagggagggagggagggaggatggataaggaaaagaacatcttaccatgcacaaaaatcttcacttgcatcccatcgttttgatgttttcatttcaaagcatatattggcatattccttttctaacactttttccccccaacttacaaattttaaaacagaaaagggtgctcatcttggttgttccacttcaagctgttaagggcatcccctgcctaaatcatggccattatgcagtatattaaaactctcatcttacagaaataggagaattaaaccaattccctgggccgactccaggaaacagtctctcttcatcctcaggcccttcttggaatcatagtcaattccaaaatctattattcttacagaaagaacattttcccagacaactattattaccatccaactgagacttttcgttttaagatctaagtactccaaactctctatttagggatgtacaaaaaggaacttcacagcacctggtacgaaagtcacaagaacaaggacatgttctgggcttctttgcttggtttttagaatgaaggtagttgcaccaaaaagcctttttgccttcttttcactgctgaaaaggggcatgttcaaatctgtcatcacatagtcaggggtttagaggaactgaagcagccattaaatggtttcttcactgtacctccctacatctttctgccaaggccacttgtcttaaagaagggatgggaaggaaacagaaaaggaaagaaaggagcatgggtccctgatcctggtggctgccctcctcccctccgctctggggcatcctcacatccctgcatccttgcacagcacagctctgagccgcatcgccactctgtcctgctcacctcctgcctgctaggcacacccatcaggacacagccccacaggccccaggtctcctcctgaagctccttccaggagtctcttccaggacagcaacttgccccttcttttcaaagctctcggccacacctccagccaacccttcctccactgtggctcctccccgtcctccctctggagtcagagtttctcctgacatacttttcaacgcctggaatgggtgtctctttctgaagggacttgcccccaccctcatccagcccaaaagcacagaaactaggtctgctccagagcctggtggcttctcccacctccacatggcaagcacccaggatgcagctgctgtcagcacacctgtcctagggccaccagctcctgcctggcctcctgcttttcctttcagcctactccccactaggcagagcatgtcacatctctgctcaaaggcctccaaaggtttttttcaggccaacaccctggtgaggcccacaagacctatggaatctctggtcaatgcccatcctggtggagcaacaccaggcacccccctgctgtggggcctttgcccttgaggcccacatgcaggcttcccacaactcctccaggactttactcaaaggccgccttcttggtgcagcctttcctggccgcctgaattttcagcatccatacctctaccttatttttttccctagtgtttgtcaatatctaacatctacacatttgacttatttctattgtggattgcctgtctcccacaccagaatgaaagccctgtggccaggcaaagtggctcccacctgtaatcccagcactttgggaggctgaggcagaaggattgcttgagctcaggagtttgagatcagtgacatagttaagaccttgtctctacaaaaaaaaaaaattaaaaatcagctgagcacagtggcatgtgccatatttcagctactcaggaggctgaggtgggaggatggcttaaacccaggaggttgaggctgcagtgagccatgatgatgacactgcacttcagcctgaatgatagagcaagactctgtcaaaaaaaaaaaaaaaaaggatggaaactcatggatttttgtctgtctgttcattgctgttctctagagcccagacctgtgagtggcacacagttcctatttttaaaaggacaaattaatgaatggcttgcaggtcctgtatgatcactgtctgacctcacattctatttctcactattcccctccctgatttatttttcttcacagaattagtgaccagctgccacaagattgacgtatttgcttgtttctttactgtttttctcctcccaccatcactaggaggccaattccaggacagagcctcacgcaaagcaggtgcccaataaccatctgctgaatggaagaattcctttcctccgcactttccaggtcaggtcactgtcggctcacacctggactgcgtaagcaccctaacttgccttcctatctccagacccttcctgccccggcacccaccgcaggaatttcctaccccaaaacgagcaaatttactatgacctctcctcagcatccctgctgctcatctccacctccactgtactctgcactaaacttgcgccccaagcaggacactgccatgcacaccctcagctgagaggccttcagtctccctcctcttgacctactatacctagacattttttaggagttccatgttatctcccctgggaaccttcatctgaccggcaaggcccaccctacaacacgactgggcaagggtctcacgtggacactatcacagcacccgtgcagaattcaaaccctaacactgatggtatgctggctgtcttgccatatgtcccccactgggctgtaagcagctggttaccaggtatgtgcaccagacacatttaatcaatggaggaacgtgaggctgtgggctcttcccattacatgttctgaagaacacacaccaaggtaagatgagaagtggtcggttcttatgaacacccaggagtatttctcccactctctggtaagactaaacctcataaagttactcgtcggtccatgccgctaatatctccagacagaataatctactcttgatacccaaatattctcacaaaggctgttaaaagaaataaaagcttaaggaagcttaaacgctttccctgactctgaatgatgacgcactgaaacaacaggctgtgtgtgtcacagccgtgcctgtgccaacaggaagtttgggctgttaactgggcttccaggtttaggtggtccaagaactgctgagcaaacacacagcctttttctggccgtgcttcctgtctgtactttgggatcaatgtccctagggtacgatcgttcatcagaattttttttgctttttttttttttttttttttcctgattcctgtttcttgccatgggcattcacccctatttacgcatttcctagctggctttaaaacataagaatttgcctaactagagtcctgtgggataagaagaagatcttttgctatgttccccctatttgatatcaactctgaccacatgatctaatttccatgagtcctggggcctggcacatctcttgttcttactttgacctagtggacattctacttctaagtatggatttgttctttttctttgtaaaatgtttgtgtgggtgttttgttttattttgtttaaagatctgggaagcactcatccaacacaggatgcctaagagaatctctaaagataagatccttatcagccacacaccccacctccctttccaggagacaccccacaagcctggttctcagcaacggccagatttggttactggtgcccaaccacgctgcactccagcacacctttctctagatgccttaacagctgacagcctaaagcccagctttggattctgaggcaaatgagaaaataagagccaacatttcagcctcgcaaggccctaaccagcaagcagagatgggctagccactagccacgtgtggctatggagtacttgacgagtgcaactaacgaagtgaatttcaggttttattgaatagtatttaatttaaatgtaaacgtcacatgtgactagcagccatgatgctggacagtacagatccagacaaaaagataaaacccagagctgccatgctggctattcttcaatatttacatttgcaaaggccagaatgaaacaaggcactagcatgcagcaatgtcctggcatgatcctccctgtcactcatgtgtgggtatacccaacggtgagaccctcaaccctatcttcctctgccagctctgcctgccagcagcaccctctcacacgggtcagtcaccacccacatgagccatcacagtgagtctttacagctctcctgatctctatgtgtgtcaagtcccacacccccactgcctgcaggctctaggagcaccgcagttcaaatccacaacttctcaaataaaacccatcatcttccatcttccccaccctccaaacttatggttttccctagacttcatattttctccaaagccaacatatacccaatcaggttcttctgtataaaatcttgatgagaatccgaaacatctccttctttggccctcaaaacctcctatcacctcttctatcagcctcacctctgttcttactattcccatgcctttggtatctcccagacccaccaattcttcctgtgctaccccactgcccctgcctccaaccagctgcccccacactaatcccatccatcaggcaatgggaagcgacccactgtaacttagtcccctcactttttccctgtcaatgggcaaatcattcaaaatggtcttctactttaaaagttgacttagggtagcaatttcactagtgattaaatacgggcagtactgtgttcctgttcttattttatatatattttggagacagggtcttgctctgtcaccaaggatggcatgcaatgacacaactgctaactcactgcagcctcaaacctctgggctcaaagaatcctcccatctcagtctcccaagtaggtaggactacaggcatgcaccaccacgtccagctaatttttaaatttttggtatgaatgagggtctcgctatgttgccatggctggtcttgaactcctggctgcaagtgatcctcccaccttggcctcccagagtgctgagattacaggcctgagcatccgcacccagcctataacatgttttctaacaaaactatccacaacccaaaactccatcccacaaactattcctttgtaaacattctttgatgaggttttgttttcgtgttttccttcttttatgtaatctactttatcttgagctttgggagttcagactaaggttcatcttggcatccctgacaccaaatcatcctgggagctcatgtttggactctctgccatctctatccttggcatttctcccctcccagcagctccatcccatgattccagctctattcctactctttgtagttcaatttagcataattttaaaaactattttcttccccttttaaggcttccttttatagccctagactgggataaaaattccataacatccttaattaaatggctctactgttaaatcaactttataattaacatcatatttacacccaactatggcttacgtccacattcccagctcccatgctctcacagggactcctacttaggttggatctggaaattaatgctgtgagcagtattccttcccaaccctgccctaaaaaatgtaacagggatagagggaaaaacctcaaaataggcaagcttaaaaagacaaacatttccgtacgcaagaaacatgtatgggctgggcacggtggctcacgcctgtaatcccaacactttgggaggctgagacaggtgggtcacttgatctcaggagttccagactagcctggcaacatgcagaaatgccatctctaaatttaaaaaatatatatatacacaaaaatgtagccaggcccagtagcacgtacctgcagtcctaactactcaggaggctgaggtgggaggatcacctgagccaaggaggtcgagactgcagtgagctgtgattgctccactgcactccagcctgggcaacagaatgagaccctgtgtaaaaaaaaaaagaaaagaaaaagaaaaaaaaaacacttatggaaaaaaatggggctgacactgggacctgctgggctgagcctggaagccctaagccaggcagcctcggctccagcaggggaacaaggtgggggctgaaccaggccaggcaggcttccccactcttccatgccatggttggcaaccctggggaagacaacgagggctccaccctagggtctgcctctggactggatccataatgagaagacacaaaccccacagaagcacagagaaagagatgaaattcctggaagattccagatggaaagagaactagggagggacttcatatagtatatcagggttcccaatgatttaaatgaagtcacatttaaaagaaacacatatatataagaaattaaggaccaaaaataggcagaagttaaccaaataaaaattttagaagaagtataattattgcaataagaattcaacacaaatacatgactgtatacaaaaaataagtaaaccggaaaatactgaaggactcatccagaaggcagtgctggaagaggatacccaaatcattagagaaagcagctaaagagaaatgaggacaggctggaaggctgggccgtatcattcacagaagtctgtgtaatagtggagggcaaactacaattatttccagatgtagaaagactaagatggtgaccatccacagaccatcagtgtatcttaaatgaaaagcaaactaagagggaagaagaagaacgcaaaaaataacaaggaatgaggaagctgacaacatacaatgatgaattcaactgctaacgataaaatactacaagtttaacctagaataagtaaatcttaaattctggaccataatgacaaggcaggtggttgagacatgttcaagttcttgtcccgaaagtgaagggaagtgagagtgaatcatctcctgggctgtaagataaaataaagccaccaaagagatgaggcaacccccatgcatgaaaccttcccattcactcttcaagttcatctaatttaatcttgaacaactggactgatgcctcttcccctagaaaatctgtgtcaaccttaagctttcaacagtgaagaaaatccagtttcaaaatttttcattataggaaaaaagaaaatggtaatgccagttgtaaaattagttaaacagctctctgagaattaatacaatttaaaaaaataaacgaataaagtgtgaacgaaagcagtcaatcaatgtacttaaaaaatgccatgttcagctgggcacagtggctcacacctgtaatcccagcattttgggaggccaaggcaggtggatcacctgaggtcaggagttcgagaccagcctggccaatatggcaaaaccccatctctactaaaaatacaaaaattagctgggcgtggtggcacatgcctgtagtcccagctactcgggaggctgaggcgggagaatcgcttgaacttgggaggcagaggttgcagtgagccaagatggtgccactgcactccagcatgggtgacagagcaagacggtctcaaaaaaaaaagatgccatgttcaagttagggttggtggcatgcatccataataccaactactcaagagtctaagtcagttggcttgagccctggaattcaaagctccattatgattgtacgactgccctccagcataggcaagagtgagactcagtctatttttttttttttaagaaaagttattttcttaaaataacttttatttttttcttaaaatatatttttcttaaaataactgttatttttttaagaaaaaaaaaaaaaaaaaaaaaaaagaatcctccaaggccggaggattgcttgagctcaagctctcaagttcaaaaccagcctgggcaacataaggagaccctgtctctacaaaagtaataaaaaatattagctgagcatggtggcaggcatctgtgatcccagctacttgggaggctgtggtgggaggactgcctgagcccaggaggtcaaggctacagtgagtcttaattgtgccactgcattccaactcgggtgacacagtgagacccagtcttaaaaaataatactgacacctctgtagatccatctaccctcaaatgtcttactgttgagtctctttatcatcaggctatggggcatgccaacagtttcagatgcaacattgataataataactaatcttgaaaccaggtgtggtggctcatgcttataatcccagtgctttaggaggctgaggcgagagcatcacttgagccctggagttcaagaccagactacgcaacacagtgagaccccatctctacaaaaagtagaaaaaattagccagctgtggtagactacaggctgcacacacctatagtcccagctactcgggagactgagatgggaagatagttcaagcctgggaagtcaaggctgcagtgagctttaagggtgccactgcactccagcctgggcaacagagcgaggccttgtctcaaaaaaaagaaaaaaggaaagaaaaaaatcctagaatactattcttgccattaaccacatctccagtattaagaggaaaacatcttgaggcaagacctctctaaagagcatttttctgtttttaaaccaacacattataggtaactttatacaaatcaagtcatcgtcctacatctgggaaaaaaatgttcttactgaatataaatgaatgtgtgtaatcagccttatctgactgctatcacttatttggataaaactacctctacgctggacactgctgccataatacatatggacagtggggttccaagcagtaagtcattcatcctcccagcttgcaatatgagtgtgatgttgggttgcacattatttcctaagagtacaccttttgaagataaaattaagtcttcaacatcctccaggacacagtaagcactgggctagatttaaaatgttaacagcaatgcatacttccttcctggagttaatcccagcagatgactccaggctgagagcacagctaaaacccaagagttagcccaaagactatctcacatataaagtatttggtttgcaaatgccttaaccttcactgaaaacatgagcattaaagccaatcctatgttgattccatacggaaactactttcaagagatttaagaaaggaagatggggaatatgattaccggaagagtgaagaaagctgggtgctttgcctcgtcttcgtatttgccttctgttgaacttccagcctccattgatttggatgtggtattcttaccaatacccatcattaagagaaacgagtagtttacacagccgttggggagagcagctggaagtgaaggcttattcaagctaggagcccaggatcagccggctcttctagtgcctggagcccccgattctcaagcagagatgaggcctgcaaacggcatctcttagcacctagaaaagaagagcacagccaaatcaccccaaagcatgaaaacaacacaggccatgcagtcactgagtttcttgcacagtaaaaaagtcacactacacattatacccaagcatccaaaaaatactttacctaattacagttttcaggcacccaacaccttctttatttatagtcacctactgattctgaattgcccactagagagggggaccactaaaccaaactatcaaaaatatcacaatactagggagaaaaaaaatagctaaggtacttctttgatatgcatatggtttatatctcataacccagcactacctaatagaactttctgcaatgagggagatgttatatatctgtcctatccaacagagtcatgtggctactgagaacctgaaatgtgcttagtgcaaatgagtaactgaattttaattgtatctaatttaaatagaaatttaagatacttgtagcttgtggctactatactgggcaatgcggatacagccaattaatcatgattagatgggcattaaaataattctacattccctacatgtgcccaattaaaagcaggggaagatactcaaaagcagtaaaaagaggaggttgccaggcgcagtggctcatacctatactcccagcactttgggaagctaagattttgggagataggtggatcacttgaggtcaggagtttgagaccagcctggccaacatagtgaaaccccgtctctactaaaaaaaaaaataataataatacaaaaatcagccaggagtggtggtgcacgcctgtaatcccagctactcaggaggctgaggcaggagaatcacttgaacctggaaggcggaggttgcagtgagccaagatcgcatcactgcactctagcccggatgatagagtaagtgaaattcagtctcaaaagaaaaaaaaaatgagagggcacagaggatccctccaaggaatggcatacatacaatgaaatatgcctagctatgcctgaatttttataaagaaaaagataatgcaaacaggtaagggtgggaagggcagagtgcatcccctggtactccaattagggtgacatcagatcttaccaccaattatcttcccactaggaataaagaatccaaccaagctgccctgcaaatgtgaggacaggactgcaataagtttggaaatacaagtacagaacttgctgtttgaggaactcttcatgggacacttcattcaataaacactttggatgagccaggggaaaaacaaaatgtaaagaaataaaaaagagaaagaattacacaaattttagagttcagaaatcagaaggccaaaaaggaaaacaaagaaactgctgccagaacgtgaagttccatgagtggaatacggagagctaggtacacacatcaaattcttccggggtggtcgttcttgtttgcatattcatgcacatttgcattttcattcacgtactatccacattcatttaaagcagtggttctcaatccagagtaattttgccctgcaggggacatctggcaatgtctggagatgtctttggccatcacaactcggggagagctattaacatctagtaaatagaggccaggtgtgctgctgaacatccttcaatgcacaggacagatcccacaccaagatttcaggagggctgagattgagaaatcttcatttaaagacacttccctcctcccaaggatggcatcccagatgtgccatgttaatcctaaggacaagatcaggtcctccaagggatacactcggaacatgcatatagcagagacagcaaagcccacacagaagcacgtctatgggacttactccagcttggtcattataaaaagaattttctggccaggtgtggtagctcacgcctgtaatcccagcagtttgagaggctgaggtgggtggatcacctgaggtcaggagttcaagaccagcctggccagcacggtgaaaccccgtctctactaaaaaatacaaaaattagccaggcgtggtggcaggcgcctgtaatcccagctactcgggaagctgaggcaggaggatcactcgaacctgggagccggacgttgcagtgagccaagattgcgccattgtactccagcctgggcaaaagagtgagactctgtctaaaaaaaaaaaaaatcttgaaacttcttgtcagaaaaaaaccaaggctgggcacagtggctcatgcctgtaatcccagcactttgggaggtggaggtgggcagatcacaaggtcaggagattgagaccatcctggctaacacagtgaagccctgtctctactaaatatacaaaaaattagctgggcgtggtggcgggcacctgtagtcccagctatttgggaggctgaggcaggagaatggcgtgaacccaggaggcggagtttgcagtgagccgagatcgcgccactgcactccagcctgggcgacagagcgagactccgtctcaaaaaaaaaaaaaaaaaaaaagaaaccataccaacacaagcagcttactgacaaaggaaagataatattaacatcagacttcttatcattaacagtaaaaactggaggaaaaagtgatgtttacagcatccagagagaaatgaatgcagagcctaaaatgccacatccagaccacctcaggggtcccaccaccctgccacagcccccgccacttacaggtcctaattcattcatcacaactctgctgtttaataaggatatgaaactctaccgcagggatcactacaacactgcaaagtctgatagcccttaatatataaaatctgtgcaggccgggcgcagtggttcacgcctgtaatcccagcactttgggaggccaaggcaggcggatcacgaggtcaggagatcgagaccatcctggctaacatggtgaaatcccatctcaactaaaaatacaaaaaaattagccgggcgtggtggcgggcgcctgtagtcccagctactggggaggctgaggcaggagaatggcgtgaacctgggaggtggagcttgcagtgagccgagatcataccactgcactccagcctgggcgacagagcgagactccatctcaaaaaaaaattaaaattaaagttaaaaaaaatatatatctatatctatgtagaaaaaatctgtgcaagtgggtaatttttcagatatgttgccatgccttggttcatgagtttttcatgtctgctggcaaccacagagcctcttttgtggcttatccccttatgtccttcgcctattttctataatgtttacagagcttcattttaaggatattaatcctttacatctttgttgtatttgatgcaaacattttatccccgctttttgtttatgaatttgggggatgaccttttgagctgccagagttgtcatcatgtttgtgtagccaaatccatcagccttctacattgtgagttagccactgccacccatcatcttcccaaaatctgcaaaaaacccagagtgaaaataaacatacctaaaaataaaatctgcctgaaggagccacagtggacctctgccttgagaccaccagaagtttattttttcagaaaataaaacgggcaaataggatagtgaaatactggtagatttttacatggccacatgccatatagtcacattccaagggaccaataagctctttgtcccacatctagcatgtcagcagagctttcaaatcacccttatctatatcaactttagggaaaatgatgggactttttttcttaaagagagggggtctcattatgttgcccaggctggtctcaaaatcctggcctcaagcgatcatcctgcctcagcctcccacgtagctgggactacaggtgcaagtcaccatgcctggctaaggaaactgatgggactttttaaagcagaataaatttactctcctaggttaagttcatcttggtgttccagacatgaacatccactgcagcagcaaacccctccccaccgtccccagcgctaggaacacacagttccatcccgacaagaataccttccagcaagtaactgtgctccatttctccaccacgcatttaatttaacctcataagctacagtgggggaaccactaatgcacttcacccacctcttccagagtagtgcctggagtatcctgaagccttagacctgaaagagcacaggagaggatgagactcatacagcgcagagcagtgatgttctgagaaaggcgtcagggaagaggactgcagggctcaggaagaggggagcacctttcatcagggacagtacatggaggaagaacgaagaaggggtgagcaaagaaatgtgtccttggacacgccataaaaagcccaaaaggacagagcattccacaccccggtgcacaaggatgatgcagacactctcaaggtcagaaagtatgcgacaacccgagatcagagggtttatccacacaggatgagcgtggtgtgtataaatgccaaggtccagcggcaaaatgcaacagataaaaggggagaggtgagggaagagtggagtttaacttctgtattaaaacaagaagcaaaatctccccgggaatttgacactggggaaagtgtgtgtgccaacccgtggtccctcattgccccttttcctaccctttgcaaaagagagaaagagaatgagcaaatccactcgctgtcttggccttaatacatgacagtggggaaggaggagcagagggatagaagatcatgatggcgacaatggcagtaataactgcaattttccagttgctaagtgtcggtgtgtgccaggcacttctctgacctcttattaaataaatgacagttatttctggccagtaagcataatattacttggtttgcacacaaactctacaaaagtagaaactgagcttcagagaagtcaaataacttgccaaagtatacacagctataggcagtagaacaggattcaaacttgaatcagtaatctgaacctgccattacactgtttatacaagacataaaactgccctttaaatgctcagcttacagctgttttccctggacaaacacagcccaggccagctggcctatacacactgcctctgtgagacttgctggtgattttgccctccttgtgatttttgagggggcactgaggggcaggaatcaccttcaagctccttttccagggctgatacccaccctccttggactaggaactctctaacatatgcacttctattcacctgcatggctgctccctagcacacatcaccatggtctctcatcaacatcacaacagccacttaactcgtgttctcattccatcttttttttttttttttttgagataggatctcactctgttgcccaagctggagtgcagtggcgcgatcacagttcactgcagccttgacttcccaggctcaggtgatcctcccacctcagcctcctgagtagctaggactacaggcatgtgccacacctggctagtttttgtagagatgaggtttcacaatgttgcccagggtggtcttgagctcctgagctcaagcaatctcctgcctcagcctcccaaagtgcagggattacaggcatgagccactgcacctgtaatccagactcattccatctttttttttttttttttttttgagacagagtttcactcttgttccccaggctggagtgcaatggtgcgatctcggctcaccacaacctccacctcccaggttcaagcaattctcctgcctcagcgtctcgagtagctgggattacaggcatgcgccaccatgcccagctaatttcgtatttttagtagatgttggccagtcaggctggtctcgaactcccgacctcaggtgatccgcccaccttggcctcccaatgctgggattacaggcgtgagccaccatgccgggcccctcattccatcttgatggctctaaacacttgtccaaatggtaagtagcatgatgcttcaacagaaaattaccatgctctttgatggcttcctaatttagagtgacacccaaattccttcacaagaggtgactatggggcctatccaggccccctttcccagtccctcatggcccctactgtggttactcacaggcctctcctatctctcaggaccctgctcatgccatccctccaaaataagcccccttcatctcaccccttctcactggggtgactcccatcaatacttcctctgatcaccacctcatcatgatgtcagaggaccatgtggagggctgagtgtgatggctcacatctgtaatcccaacactttgggagacccaggcagaaggactgcttgaggccaggactttgagaacaacctgggcaagatagcaagaccccatctgtacaaaaaaaaattaaggtaaaattttaaaagatgattgtaacaaagcaagatcatgtctatctgtctgcctagccagagagctgtgggaaacagaaagaaacagtatcacagcctcaccatcttacctccacccctggtgctgaacttggcacatatattaaaggttctccaacgtttgtggactgataaatgatttttttaaggcatgtggtataatgtaagagtggttttgtttaataatcttactacatcaaacctatctgtgacacaacagatgtcaggaacaagtcgggggtgtcaacgtcaccaccatcaatgtacaccgaccaagaaagatgagggaagtattagaaaagtccaaattataactacatcaaaagatatgaaaaatctcagagaacctacaattacatagcgagttacaaaacacatgagcaagcctctttcgatgtgattgaatcaaacatttcccaaatgccagcgacaagcatctgtatcagcagctagctagccaccatctggcctgtttctgttaaggtccctgctaaaaatggtttttacatgtttaaaggattgtgaacaacagcaaagaagaacatgtgactgagatcacctggcccctaaagccaaagacatttatagaaaggtttgcccatgcctgacaataataggataaaggaatcctgctcaccatggcaagaataacgttaaatacttaaggataaattaaataaaaatatgtgtgacctttatgaagaaaacgataaaatattactgagggacataaaaaggatttgaaaaaccaaagaaacagaggatactcttcgataggaaaggtactgtaagaatattcattttccaattaacataatctacacagatttaataaaaatccattaatacccccccaacaggtcagaggagcttgctaaaaaatcctctagaagaataagcaagggccaggcatggtggctcatgcctctaatcccaacagttttgggaggtggaagcaggtggatcacctgagctctggagtttgagaccagcctgggtaacatggcaaaaccctatctctaccaaaaatacaaaaaattagctgggtgtggtggcatgcacctgtggtctcagcaactcgggaggctgagatggatcacttgagcctgggaggtagagtttgcagtgagccaagatcatgccgcttcactacagcctgggtggcagagtgagaccccatctcaaaataacaacaataataataagcaaggatagccacaaatatttgagaaataggaggagtgtggtcagtgagataagaaccctaatgtaaagttgtaataaacagaagttcaacaagtatgaaaacaaagtaactattagtcattaaaaaaaaaacccaaaaactgatgtacatatgatatggcagcacttcaaatcataaaaccaactatacatgccaagacaattggttaccaccaagtaacaaaatccagaaaaagtaagacctaacgtctacattttaacattgttaagaaagcacagaaatatttattgacatggaaagatgtttaccctgttatatatgtgttattttttaacttgcctttttacataacacagggtgaacatctttccataaagtgaaacaagccagtcacagaaggacaaatactgcatgattccacttacgtgaggcgtctaaaatagtcaaatgcagaagcagagtaggatggtggattccagggacttgggggggcggtcaatggagaactgacttcaacaggttaaaggttttaggttgccaggtacggtggctcacgcctgtaatcccagcacttcgggaggccaaggcaggaggactgcctgaggtcgggagttcaagaccagcctggccaacatggtgaaaacccgtctctaccaaaaatacaaaagttagctcagcgtggtggtgcacgcctataagcccaactacttaggaggctgaggcacaagaatcacttgaacccaggaggcggaggttgcagtaagccgagattgcaccactacactccagcctgggcgacagagcaagactctgtctcaaaaaaaaaaaaagtttcagttacacaacatgagcaaattctagagatctgctggaccacactgtgcctataattaacaatacgtcggtcaggcatggtggctcatgcacgcctataatcttagtactctgggaggctaagagtgggacgattgcttgaggccaagagttcaagatcagcctgggcaacatagtaagattccatctctacaaaaaatgaaatttttttaaattagccagaaaacaaaacaataccatattgtacactcaaaaagttgtcggctgggcctgtaatcctagcactttgggaggccaaggtgggcagattacctgaggtcaggagttcgaaaccagcctggccaacatggtgaaacccatctctactaaaaatataaaaaatagccaggcgtggtggagcatgcctgtaatcccagccacttggtaggctgagataggagacacacttgaacccaggaggcagaggttgcagtaagccaagatcccaccacggcactccagtctgggtgacagggtgagactctgtctcgaggaaaaaaaaaaaaaagttgttaataaggtagatctcgtgttaaatgttcttatcataataaaaataaaaaaataaaaagaatggtagaagatactagttttgagtgaaaaaagttatttcataagtgaaaagaattaaaagcaatatatataatgaaaaagatagtatgtacagcattaacccactgtgtatgtgtaaagtatgtggccatgtatacacacaccaaaatgttaaccaaaatgttgagtgatagaaacacaaatgacttattttcctgtttttactcctctatattttctaaactaacttaactacaaaagatgggcccaatttcacccctaagagcctcatggtgtccacattagcaccagttcttccttactcctcagactcaagtccaggggaaaggctggttccccttacagcatctaccccctttacaatgtaatgcaagcaaatcaattcagtcctttctgctgtgagctcaggatacagcagtgcggaataatgtcctcatgtttaaagttctaaaataactttgggtttcagaagagagtggagaaaagccaaggtgctacaaattatacttggtatctagatttcttaaagctccctgcagccaaagttaaaaatcactaccttaaaggaagcaggaaatcgctacagtctcaaaaaaaaaaaaaaaaaaaaagtcgcctggaaataaatgtaaacctgacagataaaaaaaatcagccatctggaaaattctgttatgaggaagtagaaaagtaaaataaaatatttagacgtgtaacaaatcttccaattccctaaggactgaatcactagctctccacccaccaacaatcacgcacaaatgcagaagcttttaatcagtacttgtttcatcagctattcagcctgtaatgatttcttttgaacttcattttatccgaccatctctccctgtccaggaaacagagtcacccctctcactgtggcttagcagggccacctgaaggagaaatgtgatggcactgtccagaagttttcagagctgagctattcgtggagttaaataccaaaaccttctgtgtttctcgaaagaaccaccaaatcctaagaaaaacctgtcctttcatgatcagcacctagcagagtgagcaggtaacacagaaaccctccaatggctgaatgaattaatcactaatagtctgcccaaagagtagaatccccctatgtaaaattcatctttaaggctgggcacagtgactcccaacgctttgggaggcctagttgggaagattgcttgaggccaagagttcgagatcagcctgagcaacatagcgagactctgactctacaaaaaataaaacataaaattcatctttatattcccagctcctagtacagaatagacagatgctctttacaaggaagtacacagggcggggggtggggcggtgtggagaagatagatgttccataaatgctaatgaaatttacatttactccaagtagacggcactgaataaatactatatcagaaatataaatccatggcaaatccatcatttgctctagacaaaaacccacacttctccaaaaggatacgagagagaggaagagccagaataagaatcagtggctcatgtgcttaagactcacatgggaagcttatttaaaatatacacttctgggccaggcacggtggatcacacctgcaatcccagcactttgggaggctgaggcaggcggatcgcttgagcccaggagttcaagaccagcctgggcaacgtgacgaaaccccatttctaccaaaaaaaaaaaacagaaaaattagccaggcatggtggtatccgcctgtagtcccagttatttaggagactgaggtgggaggatggcttgagtccagaaggtaaaggttgcagtgagctgagactgcacgactacactccagcccaggcaacagagtcagactctgtctcaaaaaaaaaaaaaaaaagacagatttctttcacacaaatacatgtaagacaaaaatttgacactgttttatttataacagccccaaactagaaacatccaaagagccatcaagaggtggacgggtaagcaaatcatggtgggtccatcaaaaggcatgctagttagcaacaaaccagagagcgtctgctgacgtgcccgacagcacaagggagctgcacagacatttcgttaaagcagccagacacgagacatgcagtctgattctcaaaagacaaaccattctacgggaagcggagagtggttacctagggcaagaatggaggaaagggctccccagggaaaggatggaacctttggaatgatagaaatctactgttttgactgtgattctggtggctccatttggatgtatatccacttgctctatgtaaacactatcgcaataaaattgactttagaagactaaaagaattaaaaaaccctgtaatcccaccaattttaaaaatgtcccctcctcatattctaatcctatagacctaccttgggggcttgggaacctgtatttttgtttgtttgtttgttgagatggagtcttgctccgtcgcccaggctggagtgcagtggtgcagtctcagctcactgcaacctccacctcccgggttcaaacaactctctgcctcagcctcccaagcagctgggattacaggtgtgccccaccacacccggctaatttttgtatttttagtagagacagggtttcaccatcttggccaggctggtcttgaactcctgacctcgtgatccacctgccttggcctcccaaagtgctgggattacaggcatgagccaccgcacccggccaggaacctgtatttttaacaaatgcacaaatattctcatgctagaggtcctcagatcacccacaccttgggataggcaatcttggctgggaaaaagctattgtctgcacttctttaaaccaatccagacaggggaagaatatgactaagaaggagtgccctctgggataaggacactcaaaacctcagcctgccaagtgctactttggttctcactaagacacaagagctttcagggccggctaggttcaatgatgaagcacatttcaaaagccaatccatggctctttgcttaaatcccattaaggggattataatcaaactgtggctgctccattaagttctgttaaatgctaacatttgacctaaatgcttttaattcaagtcagaaaagactgttggaacatatgccctcaacttgtaggtgtggtgagggctagttttgaatgaaacgctctgaattctcaaaaaaaaaaaaaaaaaatcttcaacttgtatatgatcaacttcctttgaatgaaatgacttaactggttacctaatacacagagtccgacttcagggagtttgcaattctgatgctgatcctagctataattattccatttaaagctccaagcagcaacgaatgaacttgtaagcagtggtgattatttgatcttgtgatgacaagtatgctcacagcatgtgactgaatttaaaaaaaaaataacaatcatcctgcagtcttctccaaaacactgcaggaactcttgatcttgtttgtttgtttgtttgtttgtttgtcttttttgagacacagtctggctctggcacccaggttggagtacagtcaagcaatcgcagctcactgcaacctcccacctcagcctcctgagtagctgtgaccacaggcatgcgccactatgcccagcaaatgtttgtattttttgtagagacagggtctacttgttgcccaggctggtctcgaactcctgagctcaagcaatcctcccgcctcagcctctcaaagtgctgggatcacaggcatgagccaccatgcctagccagcgctcatttttcaaaccgcaagtcagtacctactagtaggtcatgaaattaaattagtggatcttgaccagaatttttaaaacaatggcatttgacagaacaaaaaacttcagagcatatctcaaaagacaggggtaaccgagagtgtcaaggtaaaatgcttcatgctgtgggtcaggggaaaagagtctgcaagtcactgatggaaaaactctgcacactgacatgaaaggcatgttccaagtgcccgacttaaatcagattatttactgaccttaaactaacatgcccatagaaatattgtgccaaagtgagaaagcggtataagatgatggcactgatgacaaaatatcatcatattcccctgccacaatgatggagggggtacccagaattgcagcaccagggtggccttataattaattacaataatctaccagagccctaaaccaaactacccccaatgactgcaatggaaggaatctcctttgcaccctaatgtgccatctcagccttctgtcactgtctcagtttgtggacttaattcttttaagagttggaaatgttttaaaggaagccagataaaacctggatttctgagagggaacataggtaccactgccaagttccatctcagaaaccagtttccatctgtagcgagccccaggagtaatgatcccttagaggccactcccagggccccaagaggggtcctgacagtagcaaccctgctctgactgtagaaaaaaagggtccctgggcaaacactgtactagttagaaataatctaaaaatgggttctcaggtcctcaccagtgggccagagaggatgcgatgccactggataaacgtgggaaattttcctgaaacatccatggggtgagttgggtggggaggatcattcctaactgacagcaaatagtttatggcacataaagtaaaatgcacaactgacagaatgaaacaagatgttgaagaatgggctctgcctacagaagatcccttcagtccagcccaaagacttagtcccagaagctctggtacagacaagctctagtcccaaatgcaacactaaatcctaaaaaagctcctgagtccagcctgagacacgtcattttgctgccatcgaattatgcatgagccatgaaaggtgatggtcatggtatctaggtgacaagacgataactcatttgcctgcttgttcagaagagcgatggagtctgagaaagtaaaatgtcagagtggtgtatgctttgtttgtttgggggtttaagatacaaagtcatccgcagtctttctttttctaacctaatgctatagcaaacagatgctacagcgcctactgtacctggtatctttcagcagaagttttctttccaaaactttatttaaataaaattataacaagaccatcttaagcctcgtcatcctggccatttctcctcagtgccaggtgctgcccacactgcccacgctgacctccagagttcccaggtctgggctcaagagacctcctcctccagggagcactcctgggtcagctgtccgtcttctgtgtttccatggttcccagcttcctgtccgctccccaccagaatgagatggcagcagggacacagtgtccaatgcataaaaggcattcaaatacttggggaaatccctgactcgttcagggaaatcttgtggctgggacgtgaaaggggaaagggaggggcagtatagcaaaaagtgcagcctgcatgacaaaattaaaatctgaatgtacattttagcaaactaaagcagaacaaagatgagttttattgcatttatttctactacgtgatttaacacatcactttttgcacacatggtgctttttatttcaacactatttaaaatgtattaatcatcagtcatcacaggagccactgaaaagctaattttatatggaattttaacaacaagataaaaacatgtgcataatgaactatcaagtcccaggcacaaacatggtttcacttagcccttataaaaattctgggaggggttgttattctctccatttcacagatgagaaactggagcacagagaggttgatttatctctgcaaaaaagctcagggccaatgttgtgggtccaacaatcattctggaagacaaacgttgttcgtgttaccttccaagctaagagaacgagactctgaagaaaaggccaaaagaccagaataggcctgagaaggtcatatctaaaagtcattctgaaggaagctgaggaaaatttgtgagttactttcagggaatagaaagaatgctttcttctcttccaggtctccagatgccttttgtcatttgatgctccccctggctcacccaatacaaaaatcttgggagcctggataacttccaggagatggctgtgccctgctgattcagtcccactgtgtctgggatgcctgctccatcctctttccagcacagtccctgaagaggaagcctcagtagggcacttggtcacctccagctactgttgccagagctgcccctgctgggagaaggcaggctcaggtgctgggagaagcatctcaagtaactcaacggactcaccagccctctctgtgatctgctcttcagaccatgtcattctccaaggaccaaagccaaatttccttctttcacctgcagagaaagatccagctccactttgcctctatttcctaactacccaattacgcctgcttggttttgctggactttggcccatttattcagtcctctcaacaccaaccactttcccggtctcatctggaagacattccatttgcaaatctcttgtgcagtactgtttctccccaccacaccataccccctgctccccactagtccagtataccaagagttcctcttccctgcagactctcccaagataaggaaaagggagctctgagggattcacctgctctaatagattacctaagggctgaagagtgggtttgcctaaactgcactgcaattatctggggctgggacactaattcttccccaggttaacaccacatacgtggtgatcaaaattattgcaaagcttttccctgatcttcaataaatgggaggctttaaatattccatgcctgtatgttatacactctttttcctgcacaggagtgtgttcttcctaagcaattcattaaaaattatattcattaaatacagagactgcaatcacttagaattgtatgctacagatgtcttgcttttttctggtatctgaacctgacattttttaataacccaaagaccttaaaagaattaaaaatatatctgcactcagctataagacactctagctctccatgaagtttgtttcacttatattcctttttggttgtttacttacttttcatcagacttctgaaactctgcatagaaggaaaacataggctgggcacggtggctcacacatgtaacccctgcactttgggaggccaagacggatggattacctgaggtcaggagtttgagaccagcctgctcaacatggtgaaaccccatctctactaaaaatagaaaaaaagtagccaggcgtggtggcaggcacctgtaatcccagctatttgggagtctgaggcgggagagttgcttgaacctgggaggcggagattgcagtgagccgagatcgcaccattgcactccagcctgggtgacagagcgagactccatctcaaaaaaaaaaaaaaaaaaggaaaacataaaagaacacacagcagagctttggcaatcctggcactagattggactctgaaaataagtaatttacttacatcgtttttactttatttactctggaaagtaaataagcacctgaaaaacacagaaattttactcgctgcagatgaagtttttattgctattctctctcacatacctaagggcggtgccttctaagaagtgcataaatgttaatgttcagtttttgatatttaaattatgtctgacagcactaagaaaccctttggagattttctagtaatgcagctgtgcaaaactgagaacttctcacccacctacacaggcacagtcacacacacacaggcgcgcacacacacagaaacagacatatatgtagaaaatcagaaacatcaccagagatacaaacactcagatactcacatggaaacagatacacgcagacccaaatgcacacagacacaaacagatagtaatcaatctgtatatcctcacaactcattccccaaagcagaaccgccaaatggccttaccttcaaagtgaaactccacccttccacagaaatgtcctctaatcagtgcgtcacccaccacttctgtgccggtgtctgtgcaaccctgcgattgtcctggtactcagcatgagacgctctcaggtgctgaaggaatttcagcttttataacccacacaggctggccaaaattgtataaccgcaccacctcattagaaatgctatttgtgttacacaacagccaccacccggttacaaacagttactgcatgcctctattatggtttccttaacatcaatctgtagcaggtttctccatggcaggctggatagtctattgtagaaaccaagcagctgctgagaatacgtctcaaacctgcactaagaaggaaaattaaaacctatctttgtaaacccttcagttcagatgaataagtccacccatgctgcttccagctcagtgaaaagggagattaattttactacctggtaagtttccatttccccaatcagggcccaaagacaattgttttcaaagctcaaaaaatttcagatctcaaggtaggagttcatcattaaaaggtaggcaaagccaacaagtaactgtcacattggagagctgactgctggggtccagttcaacgtggcatccagcaggcaggtctccactgattcctactgaacagtggaagtacccatgaagacacaaaagtgatgcatgcacactgacagtctgacatcaggactaggaaagaagtcacacctgtggccagactttgcccttcccagtcctgactccaagccagggcctaccaggaacctgggcagtgggcaccctctgccctgtggaatatgcaaatacctgcctccatctccctaacaccagactgcccttcccaaatccagaaagggaactcgaggctcagatgacaaacagccaggcagaagaggcatcgaccatcagcaagggacatcttagaagatgggagtccctgagataaagacagaaaaagaaccaggacaattcctggagaaaagcagctgtaagtattcctcattcacagaaactttgaggagctcagcagtgggataagaggatgacaccacctgaccagaagtgacaccttagcagaaactggggagaaggttgggagccaggtgcttcaactgctcagggcaggagacccaccaccacaagcgcccagaacacaggtccgcacatgacacatccaacccatcaggtcaacacgcctaggggagccaagaacggtattcaggacatgctgtgaagactctaacatcagagaagatttgttgcaggagccaaaagaaaatttaaaacaaaaacaaaaacccacagttggaataaaggaagaaaaacattttttaagttggtatttttttaaaagaggaaacaagattgacaattatatggagaaaatggatcaaaaacaagacgctgaggtggggaagaacagtagggaaatgaagaaccagcactaactcagaagtaagccagagaaatggcatcacaaaagactgaaacggaggtgggtgacagacctgagaaactctgagagacaaggaaaactacagaaaggctaaggctattccgagacagagctgggcaggaaaaagcaaagaacaaggccaagctgtgactcatcagtgcctctcaagcagacttagaaacaaaaggggcaatgaagccagctatgctgtatgattccatttacacaaaacatccagagtaggcaaatccagaggcagaaagttcatcgatgattgcctggggctggggtggggatgggagtgactattcatgggttttaggattctctgcaggatgaaaaaaagtgctaaaattgtattgtggtgatggctgtacagctttgtgaataacagtatactaaaaaccactaaattgtatattttaagatgatgactatcatgatgtgtaatacacctcaataaaactttttcaaaaagaacaaatgaggtcgggtgtggtggctcacacctgtaatcctagcactttgggaggctgaggcagacgatcacctaaggtcaggagtttgagaccagcctggccaacacagtgaaatcccatctctactaaacatacaaaaattagctgggtgtgatggcacgtgcctgtaatcccagctacttgtgaggctgagggcaggagaatcgcttgaacctgggaggcagaggttgcagtgagcgaagattgcaccaccacactccagcctgggcgacagagcaagactctgactcaaaaaaaaaaaaaaaaaaaaaaaaagaacaaatggagcagacttcaataacctaatataaaagatgtagactaaaaaactattctgagattaagaaaaatctgagtaaagggactaaaagggcattctaggttcatgcaaaatcatatacttggacacatcctagcaaaataatttaaccacaggatgaaagaatcgtagacacatccagggaggagaaaatgtttggtttgcttaagtgttagcttgaattaagcttagcacctgggttgtccacagcagtattaaatgtcagaagacaataacacaaacacaaactgagggaaaggtcttaacaaggaattttatacccagataaggtgcccttcatgtgtgaaagccaaacaagatagttttagatgtgcatgagctcaaaagaaaaggagggaaagaaagcctgaagctatattccaaccaggttggaatatagaagtggaattcacagaggccactaactagtatacaagactgctaagcatggatgctaaaaccatcaagatagggacaaagctaaataatgagtgtaaacctggttataaaacgcaatgcataagccacattgctctctaaacatatgctatataagaaatgtaattaaataggccaggcgcagtggctcacacctgtaatcgcagcactttgggaggccaaggcaggtggatcacgaggtcaggagttcaagaccagcctgatcaacatggtgaaactccatctctactaaaaatacaaaaattagccaggcgtggtggcatgtacctgtaatcccagctactcaggaggctgaggcaggagaattgcttgaacccgggaggcgaaggttgcagggagccgaaattgtgccactgcactccaacctgggtgatagaacgagactcaaaaaaaaaggcctggcgcggtgactcatgcctgtaatcccagcactttgggaggccgaggcaggcggatcacaaggtcaagaaatccagaccaccctgtccaacatggtgaaaccccgtctctactaaaaacacaaaaattagctaggcgtggtgatgcgtgcctgtattcccagctacttaggaggctgaggcagtacaatcacttgaacccgggagatggagactgcagtcagccaagatagcgccactgcactccagcctggcaacacagcaagactccatcacaaaaataataataataaaattaaattaaataaaaaaagaaatgtaattaaataaagcagacagaaaagattacattaataaagactgaaaacagagagtaagaagatgctaaagcccttctcccaaacagaaagaatcataggccttaactatgacaattagagaaacgaggtttttttttatgtttttcacttaaaaccactattagaatttgaaacagaatacagactaaaacacagctagacctgtgagttaaacccatttaattaaaaatactcagattgcatcaaaaaataaatgccagccggatgcagtggctcacgtctgtaatcttagcactttgggaggctgaggtgggcagattacttggggtcaggagttcaagaccagcttagccaacatgatgaaaccccatctctactaaaaatacaaaaattagctgagtgtggtggcgcacacctgtagttttagctactcgggaggctgagacaggagaatcacttaaacgcaggaggcggaggttgcagtcagctgagattatgccactgcacaccagcctcagcgacagacagagactgtctcaaaaatagataaataaaaataaaataaatgccaacccccaagatagaccttaaagtgaaaaaaagtaacactaatgctgccttattattttttaaatgtcagacacagtggaattcatgccaaaaagtattaagcaggagaaaggatgtcattttacattgctaaaggataaaattcacaagaagaatatgatgtcagtctttacattctgaacattctttcactgaaataaagcccataatggctagaaatagagaagaaatgaccaacacttcataaacatatctctctccaagaagataggggtagggaggatatacaagcataggccccatgtccatattaattttattttgtattgatcacagaatctgaccaataaaatgaataaggctaatataatagatatcaaactttgcaccccatagaaaatagcttcattttcaatggctaaagagcatttatgaaaagtcaccatctatcatgccacaaggaaaatttcaaaccccatgaaaaaaggaacatttcagctgggtgcagtggctcatgcctgtaatcccagcactttaggaggccaaggcaggtggatcacctgaggtaaggagtttgagaccagcctggccaacatggtgaaatcccgtctctactaaaaatacaaacaattagccacgcgtggtggcgggcgcctgtagtcccagctactcggtaagctgaggcaggagaattgcttgaacctaggaggtggaggttgcagttgagccgagattgtgccattgcactccagcctgggtgacagagcaagactccatcacaaaaaaaaaaaaaaaaaagaaagaaagaaagaaagaaaccaaaaaggcataaaactcagtgtcaatttttgaataaaactcttagcacattacacatgttaagaaaaaagtcctcgaaaagaaccctgatctcataccaaaggcaatgagatacataacctgaatgacacccagaggggtgccctttaaagacagaaacaggagtctggtgggtgccattatagaagactgttccggaagttctagccaggacaataagaaaaagattttgtttgagcacggtggctcaggtctgtaatttcattgttttgggaggccagaaggatcacttcaggccagttcaagaccagccagggcaacgtaacaagacctactctctatttaaaaaaaaaattatttttttaattagctggacatggtggtgcatgcctgtggtcccagctactgggaaggctgaggtaggaggactggcttgactccatgagtttgaggctgcagtgaacaatgactacatctctgcaatccagcctgggcaacagagttaagaccctatctctaaaaagaagaaaaaagaatttgaaagctcaaataatggaaaagggaaagcaaaataattatttataggtaatgcatctgtctacccagaaaatgagttaaaacacacacacacacacacacacacacacacacacacacacaccctagaataagatacttcagaaagatagtaagttataaaatgaatatacaaaaaattcccatacatgagcactaactcgtgattcccctctctttaaagtaccgtataggttgggtgcgatggctcatgcctgtaatcctagcactttgggaggccaaggtaggagtaacacttgacctcaggggctcgagaccagcctgggaaacatagtgaagccctgtctctacaaaaaatacaaaaaaattagccgggtatgggggcagtgcctttagtcctagctacttgaagggttgaggtgggaggatcgcttgagcgtggaggtcgaggctgtagtgaacagagatggggccgctgtactccagcctgggtaacaatgtgagattctgtctgaaaaataatttttttttttaaaaaagtactgtatatatacatgtgcgattgagctttaaaaaaaaaaatggctatgcaccaagcagcttatggtggtaatctctataatataggggttacgggtgtttctttttgtgtttatctgcattcttaaaattttagttatatccctctccttatattaggaggaaaaattatcaatagctcaattcttagtatgtatgtatggttagaaaactcagggcagaaaatagggcaaaacaactaaaatgctaaatatggacaaatacaagaaaaaaacttttaattcttcagaaataattttgcatttgaaaatatctaatctgattaacataatctctgatttgttttccttttatgaataaaatctaaaatgtgtttttcttttaattccacatttggaatcatcatttctgtctttccagataaatgttagatattgacatttctgtgcccctgctgttgtaaaactgagtaaaacaacaaaagagattcaagattatcagctagacaaaacctactttgactctgtaataagacaagggggcagatgctagaaatgctaaaagcaaatgcattaacagcaccctctagtgttacgaaatctaatggcacttggtagaagaaacctaaatgtaagatttttaaaaacttcttctggaaaatttcaaacatacagaaaagtagacaaaatgaaaacacattttcatttcatattcaatttgcttccaattactgactgttcttactcttgtagcaacttttatatttcattaagaggtgtcagaggcaaccaggtatctctgtgggcccttctctgccattcgattagtaattcaactaataaaatccttggttttaagttgggcacacaaccaactaaattaactgaggcaacatttcccaggctcccttgcagctagatgcagccagccttagccaacggatatgggtgaaagtaagcatgccctcccctctcccttccctcttcttttttttttttttttttttttctgagacagagtttcactcttgttgcccaggctagagtgcaatggcgcgatcttggctcactgcaacctctgccttctgggttcaagcgattctcctgcctccgcctcccaagtagctgggattacaggcatgtgccaccatgcccggctaattttatatttttagtagagacggggtttctccatgttaatcaggctggtctcgaactcctgacctcaggtgatccacccaccttggcctcccaaagtgctgggattacaggcgtgagttactgcgcccggcctccttccctcttcttactggctgcaggaaccaccttggactatgtaaaagaatcaatactctaagaagccaagcatagtggcttatgcttataatcccagtgctttggggggcttgagtcaggagggtcacttgaggataggagtttgagaccatcctggacaacacagcaagactcccatctgtacaaaaaaattttttttctaattacctgggcatggtgaggtgtgcctgttatcccagctactcagtaggctgaggcaggaggatgggttgaacctaggagttcaacgttcagtgaactatgatcatgacactgcactcaagcctggatgacagagcgacactatctctaaaaattaattttaaaaataagaatcaatactctagaaattttaaagagggggatagattatgtgaggaaaaaactttgatggtcttatcccagcatgtcagagcagctaaaactataacctcaaaaaaaaaaaaaaagaaaagaaaaaaaacccaacaggctgagcgcagtggctcacacctgtaatcccagcactttgggaggccaaggcgggcagattacctgaggtcaggagttcaagaccagcctggccaacatggtgaaaccccatctctactaaaaatacaaaaattagccagacatggtggtgggcgcctgtaatcccagctactcgggaggctgaggcaggagaatcccctgaaaccggaatgcagaagttgcagtgagccaagatcgtcccactgcactccagcctgggcaacagagtgagactccatctcaaaaaaaaaaaaaaaaaacttattaaattggcttctttggcagacacttaaagcctggccactcaaaacctggccactcaaccataatctcaagccatgattcagaatgtgtgctgacaagcacataccacaattccagcaatgaagtaaaaacacttcatccaactctcaaagcaaatccactgtgaagactgtctgcacccttccagctcaagactcacattacagtgtgtcctagttagcaggctgcagtagaagggttagtggtaaagcatcactgcactggcatccgtgcccctcactggagaccatgcatggtgcagtatgtgcaggaaagtcattaaccagtgagccgaaaatgcctctgtaaaataagattgctgccctactcctgtagtttctgcacttctctttttagtactggaatgagtattctcagattaaatcttatttaaagcctagaggggagggggagaaatcacaccagtaggtggatggcatcattaaaatggaggtttaacattcttcactataaagttttaacatacattttccagaaataaaatagtccaactagtaaatgaaaaattctatgtatttcttagcaacaaaatacatttatctaattttctagcagtagctgcaaatgtttatttatcttttttttttgagaccgggttatgagactggctaatttttgtatttttggtagagatgaggtttcaccatgatgccaaggttggtctcaaactcctgagctcaagcaatcgacctgcctcggcctcccaaattgctgggattataggtgtgagccaccgcgcctggctgagtagctgcaaatgttacgctgtactataccatctctttactatttggttaccctaacacaatgctctgattttgaattaaagagaaagaaaaaaagatcatccaagagcaagaagggcaaaaatcaattactttaaataactttaaaatacaatttgatttttaagtttcattctttggattaaaaagctgtatgaaagggccaggtgtggtggctcatgcctgtaatcctagcactttgggaggccgaggtgggcagatcacctgaggtcaggagttcaagatcagcctgaccaacacagagaaacccgtctctactaaaaatacaaaaaaaaaaaaaattagctgggcatggtagcacatgcctgtaatcccagctactcaggaggctgaggcaggagaatcacttgaacccaggaggcagaggttgcagtgagccaagattgtgccattgcactccagcctgggcaacaagagcaaaactctgtctcaaaaaaaaaaaaaaatggtgtatgacatacctattaaaatggctagaacaaaaacagacaataccaagtgctgacaagttactggaactctcatactcttgggtgggtatgcaaaatggtacaactactttggaaaaaccatttggtcatttcttatcaagttaaacataagtttccataagacccagcaatactactcctgggcatctatggctgaatgaaaccttacgttcagacaagaacatgtacataaatgttaataatggctttattttttatttgtatttatttattttgagacaaggtctcactctgctacccagactggagtgccgtagtacaatcacggctcactgcagcctcaacctcccgggctcaagtgatcctcccatctcagcctcccaagtagatgggactataggtgtgcgctaccacacctggctaatttttctaatttttgtagagatgaggtttcgtcatgttgctcaggctcttgcccgggctcaagcaaacctcccgccttgacctccagatcactgggattacaggcgtgagtcaccatatcagctatttttatttttagacacagggtctctctctgtcacgtaggcaggattacagtggcaggctcatagctcattgcagcatcaaactcctgagctcaagcaatcctcccacctcagcctcataagtagagagaactacagatgtgtactgccatactcagctaattattttttattgtcattgtttttgtagagatgaggtctcgctatgttgcccaggctggtctcaaactcctgagctcaagagattctcccacctcagcctcccaaagtgctgggattacaactgtgagctatcatacctggcctctagcggctttatttataatagccaaaacctggaaacaacattcacctttaactagtaaacatcaactagtgaatatccacaaaccacatggcctatctctattaaaacacaattatcatttcacattcatcagataaggctagaataagagtttagtaatatgaagtattggcaagactgtgaataaacaggaattcctgtatcttgttgacagagaagaaaattggttcaaatacttgggagaaccactgctaatatttagttggttgaaactgtgtatgcactatgatccagcaaggccagttagcatacttcaccccagagaaacccacccagatgaagacagtcattctgttcattatgctatgtcaagaggagaatatctaagttatgctatgcttaatcaatgaaataaaatactgtagttaaaataaacgaactctagctacttggaccaacatttgggaacattttccagagtgattaagtaggttgtagcgcacgcgcacacgcacacacacaagatctactatttaaggttttaaatcacgcaatcattattatatgttggtttgtgaatatataagcatgtaacacaaaagtaaagacacggactgtaaaggtacctctgggaagaagagaaagagggagatgaggctagcagagaggacaaaccaggtatctgaaatgtttcaatttccttaaaaagcaaaaacaaaatacctgaagcaaaaatgacatgtttagatttattaggtctgggtatctagcaggtaagttttcattctttagttttctttatatttgaaatgtcacaattaaaagcaaatgtttaaccaaagactatctatctttaaaaggatatacagtctgaacacacaaaaactggtaaaagtggctgcctccagagatggaaactgggacaaggaccagacaggaaggaggcttattctccctgcctggcctgtcctcatgcacattctgattacacatccttttttttttttctttttcttttttttttttttttgagacggagtctcgctctgtcgcccaggctggagtgcggcggcacgatcttggctcactgcaacctgcacctcccaggttcaagcaattctccctataggcacgtgtcaccatgcccagctaattttttgtatttttagtagagacggggtttcaccttgttagccaggatggtctcgatctccctgacctcatgatccgcccaccttggcctcccaaagtgctgggattacaggcgtgagccaccacgcctggcctatctatttttttaattacaaataaattttacgccctctttatctccaatcccccagagtggggcctatctaaagcaagcttgtccagctctcggcccaggacagctgtgaatgcagcccaacacaaattcgtaactttcttaaaacatttgagattttttgcgatttttttaaagctcatcagctatcattagtgatagagtattttatgtgtggcccagggaagccaaaagattggacacccttgatctaaagtatttttatttcagataaggacaggccactgaacacatgactgagattccagccctgactgtgccattaatgatgggaggagatttaattttggggatgatttaaccccctccaagtatcacatcacttctaaaatattgtcttttatgaaaacacaaacatatccccctcagccagagaatctctaactaagccacagggagcgaaaagcagttctcatataaccctgataggaaaacttttggaatttgttcggacagttccacacagaccatctgcagtgattgcctcatagcctctgtgggtagagatgtacgtagacagttgcccttatgcaaggcagcatgaggtgagagaagggcaggaagttgggggagtgcttatctgatcacttgttttcttaatgaactaagaagcagaggtcatggctgagagtaaaaaggctgggaatgggattggacagaagtgactatggaagaagaaaaacgatgagaaaaatgatattattttaaaaaaaaaaatcaaagtccagctgagcccagaactcataatatgaaatagagaaagtcaccttgttatctggtttctctccagcagagttcaaccacccccgccccaaaaaaacagaatagttaagaccagggcactgagggagcttgacaagttctggagacagctcagagagggaggagaccatgttagtaagatggcagccacgtgatttcctgtggcgtccatagcaggtaaaaaggactggggaggcaagaggaagccagagagcaccacagagctggagcaccaggaccaatgaaggggaggaatgagagctagggaggacagggtgtgtagacacactcccagctcaggatcccaaagtgctgtctgggagacgactgggccttggagagctgatataaactggaagtaaaactacctgcaaaaggtaaaaggtcagtgaggtcccgtggccggataagccaatgactgagagatgatgctagaagacacagtggaaagaaatgtggcaggccaggagccaacattcaaggggcataaagaaaggtcaagaagttgctagatggcctggcgcagtggttcacacctgtaatcccagcactttgggaggtcgaggcaatggatcacctgaggtcaggagttcgagatcagccttgccaacatggtaaaaccccatctctactaaaaatacaaaattagccgggtgtggtggcatgcacctgtaatcccagctactcagggggctgaggcaggagaatcgcttagaaccagggaggcggaggttgcaagtgagccaagataacgccactgcactccagcctgggtgacagagcaagactatctcaaaaaaagttgccagatgatggcaaagaggaaaaaggcttcaaaactaacagtggtagttgaattaaggctggaggacacagcctgctattccctctacctggaaatactgcaacacctggagaatgtaaatatcaattcctcagcaaatcctttccacatctcccaaaatccaaaccactcacttcactctttgctattctcccaaagcaaggagcacaattcatgccaaatgtccttcgttatccaaagttatgcttttctcaagttcatgaagccaaccagggatccacgttttctgggtctatccagttcctaaattgtgatcagcagaaaataagcgaagggtatatacctaaagatgtatccagcaagccaccaagtcaggaaagcaggtgctctggcatgctggcttcaggaccccttagtcacagccacttaaaagtagtctgcatggctataagaatccctaaggctgccataactcctttaatatgattctctgtgttgccaataggaatatgaccatatgtaagctttcttattaaaaaaaaaaaatgtaaaaaatctgaccaggcacggtggctcacgcctataattccagcagtttgggaggccaagatgggtggatcacttgaggccaggagttcaagaccagcctgcccaacatggtgaaaactcgtctctactaaaaatataaaaattagccaggcatgatggcacacacctgtagtcccagctactcctgaggctgaggcaccagaatcacttgaacccagaaggcggaggttgcagtgagctgagatcgtgccactgcactccagcctgggtgacatagtgagactctgtctcaaaaaaagcaaaaaatcaaaaaggcagaaataaaataaaatgtaccatttataatttacacaacaaattgtaattgtaaatttagtaaataatttttaacatcccgttaacatgcaagcactttggatatactgctagtgggagtaataattgccattaacttatttttttttttttgagatagggtctcactctgtcgccgaagctggagtgcagtggcacaatcatgactcactgcagccttgaccttcctgggctcaggtgatcctcccacctcagcctcccaagtagctgggattgtaggcacatactaatttttctatttttggtagagatggggtctccccacgttgccctggctggtcttgaactcctgggctcaagcaatccgcccacatcagcctcccaaagtgctgggattataggcgtgaaccactgcacccagacataacatttttagatggtaatttaacatcaccaatcaaaggctctaaaaatacacatagcctttgacctaacaattttactcttaaggaatttatcctagcaaaataattaaaacaggcttaaatttttcattttgtgagtgttcattaaaataatgcttaagagtaatccaaaaccggaggggaaaatattaatgcctaaaatagaggactggttggtacaattgtgggcacattcttatatgagcatattacagagattaaaacatgggtgactgacgtggcaacgtaaggagtgcattattaagctgagaaaaagacaggcttacaaaacaaacctgataatcccatttcagtgtgtgcacacatgcagaaaatgaagggacaccaaaaaattagccaggtgtggtagcacactcctgcagtcccagctactcaggaggctgaggcaggaggatcccctgcacccgggaggtagagttgcagtgagatcgcaccactgcatcccagcctgggtgatgagagcaagactctgtctcaaaaaaaaaaaaaagaagaaaagaaaaaaaggaaggaagagaagagtagaagagaagggaaaagaagaaaaaaaaaaagaaaggaaaatggaggaaaacaccaaaatagtacatgattatctccagatgatgggattatatgtggttttttttccccttatttttctacagtgtacatatgtcactttcataattcttaaaagcttgagccattatctaaggacaacactgaaataaatatacaggtaagacaaactagaagagaaattctggcagtcaacaccagtgctgagaaaaaacaccctattgatatagtcagtgtgctcccggagagagcgctgggagggctagagtttcctggtaaccaggagcctaaatttatcattcctaagggcttgctgatggcacctgagtaacttaggaaaccaaaggtgtggtcaaaaggtaagcgctcttcatactcggtaaacctactgtgttcaggggttcctgattttccttaaatcctttttattcttggatctcaactcttccaagggctgtctttatctaacattagttactatacttcttcacatttcctagatcttctttatttgaaaaagaaatgagactcattcattgcaaccaaactttaacttgtcaaaattataaactggctgggcccagtggctcacatttgtaatcccagtactttgggaggccaaggcaggcgtatcacttgagcccagaagttcgagaccagcctgggtaacacagcaaaaccccgtctctacaaaaaattagccaggtatggtggtgcatgcttgtagtcccagctaccaggcaagctgaagaggaagcatcaccctcagccgggcgcggtggctcaagcctgtaatcccagcactttgggaggccaagggaggcagatcacttgaggtcaggagttggagaccagtgtggccaatgtggagaaacaccatctctactaagaatacaaaaattagctgagcgtggtggcatgcgcctgtaattccagctactcaggaggctggggcaggagaattgcttgaacctgggaggcagaggttaaagtgacccaagattgtgccactgcactccaccctgggtgactgagtgagactccatctcaaaaaaaaaaaaaaaaagggaagatcaggagatcaaggctgcggtgagctataatcataccaccatactccagcttggataacagagggagaccctgtcccctccaaaaaaataaaattataagctatagaacgtatttgtgattcttgggtaaaaaagaaaaatatacatatagactggggtagggggcagcaggggagatcaatttacttgttgaactggttcatgtgcattttccaggcaacagaaaatctaaatttgaaaggaaaaaggtgaggaaggggaagctttagtagcatcattcaagtgtgagtatgtattattacatagtccctgaaatagaaggggcttacattatgaaatactgaaaaatccaagagcttggaagttgaaaacatattgctcagtggtaagtaaagctatgtggggtttaaactgtgctatccaatgcgggagccaccagccccaggtggctactgagcatcttaaacgtgttggtccaactggtatgtgctatgaatgtaacatatacaatagacttcaaagggttgctatgaaaataaaaaagaatgcaaatatctcattaataactttatattgattgtgttgaaatactatttttaatatatcagcttataaaatatattactaaaattaattgttcttgttttcctttaatgtagctacctcaaaattacatatgtgacttccattataatggtattaggcactgctagtctaaaatacgtggataccagggaaagagaaaatgctatttcagtgcacacaaccagggtaatcataagatcacatcctatggatgtgtaaacttttgatagttttacacacacacacacacacacacacacacacacacacacacacacacaggcatggccatctttatccaaacatcaaagacaaccctattattaatatcctacacagtcagctgggcagattacatgatggggagcaggtgccataacctaattttccacacacagaactgagaggagggaaggaagcagatataaaagagaccaaagcagaaatccagaagcagaatccagtgctaacgagaagcacaagatgaaaggtcagaagggctggaggcaggggctctttgagggaagcccagaaccagtacaagaaatctaaataaacacagggcccatccaaaggtaaacattactcaaatccagaaaggctttattgctattgatctgcaagttccagtttatggcaaacctaaaacaaaataatatgtgtatttaaaaaggattatcattagaagtcatgggacaaatttattgatgagttttttttttaacaccatacagaaaaatcagcaaacaacttagacaatttataaacagctggtcttaatccaacactaacatgttgatttttcaaaataaccagttgaaaaggccagacttgttctaatttgcttggaatctctttcatagtaactgttacacaactgttccatcttccttccttaccttcttatgtaagctctgtaatcaccatcagtgtttacataggtttgtgaaaccacccaatttctccagtaaatatttaattctctttgctactgatcaaaccataagcaacacaacatttttatacgacatgtttggtaatgagaaaatgagacattgacgtcaacagcacaaagtctataaaccaaaaacaccaggatttcccgatacataggcctcttggaaatcaggcaccaataaaatagaaaattctcttcactgctccaagtgtttgatccagtttataactgagttccgcagcatctgtggtggttctagcaaatgctaaaatacccttcaaccagaaccatgcacccagtctgcaggcttcaggcaccaagcagaatgggtgttctcagctatgaaagccaggcactcaacaatcacctgtatgttattaatgacaaaaacgaaaggtacgagcaagcctcctcttttctcagtttagtaagaccgtgatattttaggatctgtactgatcatctcaaggcaaatggaatgacaccaaccatccaactagatccctgactgcccttggtgggctggagcaaggagatggagatacattatgctgaggctctttcccatctgattgtacagtccggacacctagcaaatcagagaaaacacatacaaccatagagctgggcaggagagctcaaggacactggaactccaggctggaagttgtcaggaatgacttttaggaagtgagattagggttagccttgaaagatggcgggaatcccaagagagatgccactacggaggtccagaggtaggtggcatatgatgcgtcttttgggcgctgaacacaacagcctaaccccagcacctggaggtcagaggacagggaggcaaaggaagaaaaccctttgtggagtcaaagtagccttgaaaagcaaactcaacacagaacggcttcatgcaacatgagtttctgggcaggcgaggagagcagtcgtccaccacaggataatctcaaaatggggatcaagaagctactgtgttaatccaaggaaaatgaccttggcaactgcaatggtgaaaatgccaatgagaaaaatggatgaactaagggagtgatttcaaagaaagacctggtattaaaggtgacctctaagaaaagagccaggtgtcctcttccttcagaactaagaaaacaggcttgacaaggtaaatcattaaaaaggtcaggatgtgtatttttcttttttttttttgagacgacgtctgtctctgtcacccaggctggagcacgatggcatgatctcggctcactgcaacctcagcctcctgaggtcatgcaattctcctgcctcagcctccagagtagctagcaatacaggtgtgcgccaccatgcctggctaatttttgtatttttagtagagacggggtttcaccagccatgttggccaggctggtctcgaactcctgacctcatgatccacccaccttggcctcccaaagtgctgggattacaggtgtgagccactgtgcccggccttgttttgtttttagtagtaagtagagacttctttattagaagtgttttttggttttttttgttgttgtcattgttttgttttgagacagagtttccctcttgttacccaggctggagtacaatggcacaatctcggctcactgcaacctcctgcctcccaggttcaagcgattctcctacctcagcctcccgaatagctgggattacaggtatgcgccaccatgcctggctaattttttgtacttttaatagagacagggtttctccatgttgtacaggctggtcttgaactccggacctcaggtgatccgcccgcctcagcttcccaaagtgctgggattccaggcatgagccactacacccagcctttattagaagtcttaaaatttttttaaaaggagtgatcccctctaagtatttgtaaaagctcttataagtgtacacagaaagtaaattttactgcacataaaatttttttaaaacaacactgacataacattttacatccaccatactgaataaatttagttttaacaagtcaatgtatctgacagcatcctttttttttttttttttttcttgaggcagggtctcactctgccacccaggctagagtgcgctggcacaatcagagctcactaaatccttgaactcctgggctcaagtgatcctcctgtttcagtctccagagtagctgggactataggcgtgcaccaccacatccagaagcagagtatctgagagaatgtatcggcagatgtgaaacacttgcggcttttctgaaggataatttacctatacatgtatcaaattttaaaaggtcatgcactgtgcccatcactactactgctaagatgttttccccaagaagaaatttgattgcagtattgcttataatagcaaaaaattaaaaataatcaaaatgttcatcaagctttggggataagggaaacaacagaaggaggaaaaaaagaatgctcctgagtaatgtacatgtggttagtctcattaattaaactgcagagaatgcttgaaaaggggtgaggaaacaattcttaaatctctttccactccaggttcctcacgtataaacctcacggagggccaagagcaggaggtactcaacaaatttttgctgataataaagtcaaaagcatgaaagaaaactgaaaatatttacctcctactttgtaattaatataagtggcaagactgtgcctgtttattttctagtttaatctacttgcgtggaatttggcctaaagaagtctattaccttatcattagcattaacctaacaattcattattccaaaggttgtgcatttagaccgttctcaacacgtaaaaaacgtacaaaggtaaggtcaagtacaaaagggttctaatgctacagagctgccagcccaattctaccatgaagcataactagccaggcatggtggctgaagcctataatcccagcactttgggaggtagaggcaggaggatcgcttgagcccaggagttggaaaccagcctagataatatagtgagaccccatctctaagaaaaaaaaatttaaaaattagccaggcaccatggctcacgtctgtagtcccagctacttgggaagctgaggtagaaggatcacataagcccagtaggccaaggctgccacgagctgtgatcgtgccactgcactccaccctgggtgatagagcaagaacctgtttcagaaaaagtaagaaaaggaaaaggaaacacaactggagattgtgttttacacgcacctaagtgatgtggcgtagacctgtccatatgctttccattacaattcgctgagttacatttgcttatgcaccaaggtccaagttcaaagccgtatgagaagtccccgttagtggagtcaagacctagctggagaaaagcaaatggtaaattaaaagtaataacaaacctagcaggaggtactctgcatgaatggagtctatttttcacccagccatgcccaatcctagaatttgctctattactacttcatttttatggactgcctccaaggccccagcctgtctctaggcagggtcacaaactgcaccctcaattctttaaaaatccactctccatttctacaaagtattttgaaagatagtattttagaacacctataaaaaaacttttcagccaggcacagtggctcacacctgtaaccccagcactttggtaggtcaaggcaggcaggtcacttaagcccaggagttcgagaccagcctgagcaatagggtggtctctacaaaacacacacacacacacacacacacacacacacacaaattagccaagtgtggtggtgcacacctgtgatcccagctactcaggagactgagaggtggagaatcacctgagcccaggaggttgaggttgcagtgagctgtgcaaccgcactccagcttggatgacagagtgagactctgtctcaaaaataaataaataaataaaaagcaattttgggccaggcacggtggttcacacctgtagggaggctgggatgggaggatcacttgaggccaggagttcaagaccagcctgggcaacatagtgaaaccttgtctctacaaaaaaaaaaaaaaaaaaattatctcgtcgtggtggcacacacctgtagtcacagctactcaggaggctgaggcaggaggattccttgagcccaggaggtcaaggctgcagtgagccatgactgtgccactgcagtcctacttgggcaacagagcaacacgccatctcaaaacaaaagcaaaaaaagtgatttgcactcagttgggatttctccattgataacttttaaactccatattccctagcacagggtctttgatttaaaaaaaataaataaataagtcactttctgttaaagcctcttaaaaatgtactagcacacggggagggtgcttctcaaaaagccggtcacattctgtttctcaaactgggatatgagcaggtacacagatgtttcttttactatttattaaacggctatgttttatccactcttgtacctatgcatatgttccacaataaagggaacccagagcctgactcagtggctgtcttgggaacagccatcccagccccagccatgagcctggccctcccttgtgaagaaaaacgtgcaaggcaaccaacagtttagccagattttcactggaaaatccttatgttgagacatcaacttttaccatttgttcttgggcaagttagcatcaacaatcgccaacggccccaagttaaatagcacacaaatgccatcagactggtaccagtccagccttcaaggaaccattaatgagtcttttttttttttttaattttggaaactaaacactggtcttgtgctatttgggaaaaaatactcactttaaattattagaacgtgaatgaagaaattgatgtctttccctttctaaaacattttgcatgcaaggaaaaaaaaagtagtaatttatttctcaaaataaaatctctacacataaatctatcttaagctatgtgggggtttttggggggttttttggggtttttttgttgttgttgttgttttaaatgagacagagtctcgctctatcagccaggctggagtgccgtggcgcaatcttggctcactacaacctccactcccgggttcaagcgattctcttgcctcagcctcccgagcagctgggattacaggtgcccgccaccatgcctggctaattttttgtatttttagtagagacacggtttcaccatgctggccaggctggtcttgaactcgaccttaggtgatccacccgcctcggctcccaaagtgctgggattacaggcacaagccactatgccaagccttaagctatgtttatcagaaatttgcaatgtcagaagggaggcacaaaggtgacatccatcaatgtctagtcaagaggaataatgaaaagaacatgagaaaagaaaacaagagagacactttaaaagaatggcttactttcagttaagttataataacaaatacagttccttgaaaaatacaggttgtacaatatgtgtggttatgatttcacttttattaaaaggataattacatagtatgcatttgtgtacacagaacagggctggcaaggatacagatcaaactgctttgaagtggtggggggacataagaaaagatcgtgtgaccttctcaatttactaaacacaagtctgacaagctagaattatttttcaacatgtgtatgcttcttttgcaaatcctttaaaaaactattaattaaaaacggctccatgagggcaaagtgcaaattaacagaatgtcatttttagctacaaatcattggaaaattctgaatggggaagcgaaagtactatgactccttaaagacatgtttttggagagtatttttctaagctgagtggcaagatggctggaaggacttaactactgcacagaacaagtactgagaccaaaccacagaactgggtcagaggttttaatactgggaacatgcaaatacatttttgagaaaggaatctctgaggaaggagttaagaaggaatcacgatacaaacaaaaacaagactgagctatcagtaagcaaccttgaacttctggcagagcgctccgctgaatgcccctcccattcgtgggttccaccgcactctggaaacatgaaaactgtcctttgcacgcaaggctacggggctgagatcaaagcctgggcgctgcggcaggtcagaggaaacatcacttgggacacactcatggccacatgactttcccccatcaaggcccgctgaactctcaagaatctgttcacagtgcttctgttgcttcttaattaggatgtgcaaaagtacatactacatgctgtggtttccagacactgacttcatacagaaaacattcaacaaaaaactggggaagaaatactacagaattgccatctgtgtatcttactatgttatttaacatctaccactgactcaacatcatttccttaaaaagggatgttaactcttcaaaagcaggaaggagagaatgccagggccagtatcataacaggccagaacctttgaacagccaaatcattctatcaattcagtagatgccaaaaaggctgacaaaacacttcctcctgatttaaaaagcaaaaaccagccaggcgcggtggtttatgcctgtaatcccagcactttgggaggctgaggtgggtggatcacctgaggtcaggagttggtcagcctgaccaacatggagaaactccatctctactaaaaatacaaaattagccaggcatggtggcgcatgcctgtaattccagctactcgggaaggctgaggcaggagaatcgcttgaacccaggaggcggaggttgcggtgagccgagatcgcgcattgcactccagcctgggcaagaagagcgaaactccgtctcaaaaaataaaaaaaataataataataaaaataaataaaaagcaaaaaccaaatatcttcaatgcaaattaaaagatacttcctgaatatgacaaatatcttctgaaaacaagggcaaactcaaacactacatattcttcatgctttggcattttgttttttaagtttatttttaaccttatactacccttatatcctttatccttatactatcattcccaatgtttgtatttttttcaaggtcttacaaaagaggcacatgtatgcacttgaaaatcttgatgaaatgggcaattttggggggaaagctattttttcagtgtttttgtttttgtttttgagacggagtctcgctctgtcacctaggctggagtgcagtagcgtgatctcagctcactgcaacctccgcctccagggctcaagcgattctcctgcctcagcctcccgagtagctgggattgcagggcccaccaccacacctggctaatttttgtatttttagtagagatggggtttcatcatgttgaccaggctggtcttgaactcctgacctcaagtgatccacccgccttggtctcccaaaatgctggattacaggtgtgagccaccgtgcctggccaaaaactattttttgaaaacctgaacaagtaacaataaatggagaaaattacaaaagcaaattactcttttccaaaaggtgctaggcccagacaaattcttagttatttcccagccttcctcgtaagaaatgggaaatgaaaaagcttcccaattccttctgggaatgcagacaaactgacaaagcacaacggaagaaaactatgtatttcttcattggtgcagcggtgagtaagaaaaaaagaaaaagaaagaatatgacgttaacctcacttgccattcctagattgttttttattacttatttattttttgagacagagtttcactctgttgcccaggctggaatgcagtggtgccatcttggctcactgcaaactccacatcccgggttcaagccattctcctgcctcagcctcccaagtagctgggattacgtgcacgcaccaccacgcctggctaatgtttgtatttttagtaaagacagggtttcaccatgctggccaggctggtctcaaactcctgacctcaagtgatccacctgtcttggcctcccaaagtgctgggattacgggcgtgagccaccgtgccccgcctgtttttttttttttaatttttgcaaatatgacatgtaaagaatgacatctggttttgatcttgatttctttgatccatgtgtctacagttcttttatgaactgtaagtgccttttacccatttttttcagtacgtgtttgggtttttctgattcatttgcaagagtttctttctttctttttttttttttgagacagagtctcgctctgtcgcccaggctggagtgcagtggcgcgatctcggctcactgcaagctcttcctcccgggttcacgcctttctcctgcctcagcctcccgagtagctgggattacgggcacctgtcaccaggcccggctaattttttatatttttagtagagacggggtttcaccgtattagccaggatggtcttgatctcctgaccttgtgatccacctgcctcgccctcccaaagtgctggaattacaggcatgagccaccacgcccggccaagagtttcttttttttttcctacttttactttgctttttctttttgcaagagtttcttataggttaaggatattaaccctttgtctactgaaagcattttccccagaaaaagcaaatgactgctttttccattttgtttataccacttgaaatagaggacattttttaagtctctcttaagtcatactagtatctttttgcaatttcttctattacttttgtgctagaaagtccctccccggccgggcacggtggctaacgcctgtaatcccagcactttggaaggccaacatgggcggatcacctgaggtcgggagttcgagaccagcctggccaacacggtgaaaccccatcactactaaaaatacaaaaattagctgggcgtggtggcatgcacctgtaatcccagctactcgggaggctgaggcaagagaattgcttgaacccggaggcagaggctgcagtgcgccgagatcatggcattgcactccagcctgggggacaagagcaagacttcatctcaaaaaaaaaagagagtctgccgggcacggtgactcatgcctgtaatcccagcactttgggaggctgaggcagcagatcatgaggtcaagagatcgagactatcctggccaacatggtgaaaccctgtctctactaaaaatacaaaaattagccaggtgtggtggtacacgcccgcctgtagtcccagctactcaggaggctgaggcaggagaatcacttgaatcaggggggcggaggttgcagtgagccaagatcacaccactgcacttcagcctgggtggctgagagaagctccatctcaaaaaaaaaataacaaaaatgcatatccaatgaaatcactgttctagaaaagtaattagatgaatgtaattgtacatatttcagttgtaggacaagtagaatccactatgtaaagactgaatgaataaattacgatagcaaaacactgtatgataaaatactacagggccactctgcagtatactatcatgacacagggaaatagttatgatctattacaaagtggggtgaaaaaaggcagaacatctctctctttatgaacatgacttcttcagcaagataggcattctaggacacttactacaatattaactggatcttcccagggtttcagatgtaggtggtgtcctatttctttttgtttttctactttaaccattattaatgaacacgtattattattatttttttttaataaagacaagctctcaagctgggcaccgtggctcatgcctgtactcccagcactttgggaggctgaggtgggcagatcacgaggtcaggagttcgagaccagcctggccaacatggtgaaaccctcccatccccgactctactaaaaaactacaaaaattagctgggcatggtggcatgcacctgtagtcccagctactggggaggctgaggcaggagaatcacctgaaatggggaggcagaggctgcagtgagctgagactgcaccactgcactccagcctgggtgacagagcgagactctgtccccaaaaaaaaaaaaaagaaaagaaaagagacgagatctcattatgctgctcaggctggtctcgaactcctgagctcaagtgatcctcctgcctcagcttccctaagtgctaggattacaggtatgagctaccacacctggcctatttgtgattttttaaaagctcaaaattcataaatatatatgcaagacaagtcactaaaaacagttttgctcaatgcctaagttgtacttatcatgaaaaaacgaaagatactggtagtggctcacactgtataatctcacttgagccaagaagttcaagaccagcctgggcaacataacaagggtctctacaaaaacaaacaaaaaaattaaagacacctttcctaatttactcccgtattataaacgggataataaactcctgattcaagaaaaataggggctttgtccatcctcctaattacatgaagatctaaggagtaatgccccgatttacattcctggcaaaatgacaaagttaaaaaaacactcccatggcaactatcggtgctaataagtcaagctcagttaacacaaatggttctatttttcccttcataaactgtgcctttgcgtgtgaacaagcactgttgaccttcaactaagctgaaaatcctattttatgtctgttaaccccaaaactttctaaacctctccaaaatgtctaggagtgatcacgattagataataaccagattaaagtaactagaggtcagaattgtgaactcaaaacgaggacgacctagaaatggctaagcctgggcaggctgcttctccccagcaccctgctgaaagacagtgcttaatgaagggggtggaaagaatgaacaaaaggggcttagaaatcctgcaacctggccccccattggcaatggaagacacagaggggaaacagagtcttatccccagttggaggcagccccagaaccagaacccatactggtctcatttctcctagagacagttaaagggataatgccaggatatgcacacagggcacatgtagtacctattctgagctgtgctgagccagatgctgtgaagctacacacattaagctcccctccacaacctcaaggagccaacaagactagcaaacccctaaaacctagctaggacaagtgtttccagagagctggaatacaaacggatgccgatttttaaacaagaaccctatagggtaaaatcagaaagagttatttaaggctattatctaagtatgatgcaaaagtctccaatttaatactactagagcaaaactaagaaattaatgcaaaggaccaggcacggtggctcacgtctgtaaggctcacgtctgtaatcccagtactttgggaggctgaggcgggcagatcacaaggtcaggagttcgagaccagcctggccaacatggcaaaaccccatctctactaaaaatacaaaaattagccaagcgtggtggcgtgtgcctgtaatcccggctactcagaaggctgaggcaggagaatcgcttgaacccgggaggcggaggttacagtgaaccgagatcacaccactgcactccagcctgggcaacagggtgagacccccatctcaaaaaaaaagaaaaagaaaaaagaaattaacacaaaagagcaccatcaacccaacagacattatgtgtacccaaagggtctaaacaccaaaagcgcccaaacttaaggttcacatttactgggacaatggggccagcatggtggctcatacctataatcccaacactttgggaagcccaggcaggaggatgacttgaggccaagagttcaagaccagcctggacaacatagaaagaccctgtctctacaaaaaaaaatgtctaaatatatgaaaaaaatattaaaatatagagacaataatattggaaaatcttctattccaaattttacttttctttttaattcaaaggtggcagctgattgttccaagcattattttagcagacaagcaaataagaaatctataaaatactttaaacaaaatcatgttctgacagatttttattcatctttaagaaaaatgtttcctatgaaactttagagtttgaaaaatgagacttctaatttgaaaattaaaccaagaaaaacaatctgcaaataacacttagttctccaatacatcataaaattaccaggcaaatggggaaaatatgtataacatttattaaagtgttcacgtccttgatataaaaatactgttataaatcaccaggaaagagagacagatacaagactggaaaaactggcaaaaaaaaccacaataagccaaacaaaatataaatggccaaaagaatcattaaaaagtactcaaactcactaggtatcaaagaaaagcaaaataaacatagtgattccattcttcactcaaattggcataaaaaagaaaaaatgttttattatggcaatacttcccagtgtgttaacctgaatgcaggaggtctctggcatgtatgttaggtatgtgttaaagtcttagaaatgcaaatgatatgccttccaacaatttagtctaaagaaataatcaggaaaatgcactcagatttaggtacaatgctgttcaccactgtattatgtccaccacagcagaaaatggctcataagctaaatacctaatagaaggatttgtcaaataaaacatgatgtattcagcacaaatgagctacaaataaaggactatttagtcacatatctaagatacattgctaagtaaaaaacaggcttaaataccctctgtataatctctactttgaaaaaaatagttatatatattgtatatatgcacattttactttctttttcttttcttttttttttttgagacggggtctcattctgtggcccaggctagactgcagtggcacaatctcggctcactgcaacctccgcctcccagttcaagtgatcctcctgtgtcagcttccctaatagctgggattacaggtggctgccaccacacccggctaattttttgtttttagtagagatggggtttcaccatgttggccaggctggtctcaaactcccaacctcaggtgatccacccacctcggcctcccaaagggctgggtgattaccggtgtgagccaccgcgcccagccacagtttactttcaaatataaccagataaaagaatattcaatgagtaaaataagctactttatgtatacgcgttccaccacaatcctaatattccttaatctctctaagacaggacaccagtcccgatatttttccactaattctgaccttagttctaaccaatagcttcatatacatcaacagtatatttagatttagtggtctctatatgacagttcctaaaatagctgtgaatttcctacatattcttctcaatccatttcctactgcaaaaaggcagacacaaaaatttctgagaaatgacagatgatctccaaacaccctgctctatctttgctctctgcatagaccagggacaaccctacatacccaagggcaagtcaatagcataatcattcaatttctcaggagaactgcatcacaggtcatattacgttaaaagaaagtgcacgaacagacctaatacatttgtcatcaaagtgacacataaggacctgtaagttagcaatacgcacatttccatcccattcagtcaactatgaaaaggctttaaaagcagtataaatatctgaattttagtttatttatagcaatggtgctcagctctggctgtaccctggaatcacctggaagtgctcgggctgaatttctcatcaactgcatcctggtctcatggatgtggccagcatccgtagttttttaaagtttcccaggtgatcgcaatttgctgtcgaggttgaggaccactgacatgaagcatatttttcaaacaacagataatgaatgttccatgggagtgagtactcaaatcagtggttggggttggcaattccctccctccctccctccctttctttctttcttccttccttcctttctttatctttcagatggaatctcactctgttgcccaggctggaatgcagtggcaagatctcggctcaccacaacctccaccccccaggttcaagcgattctcctgcctcagcctcctgagtagctgggaccagaggtgcatgccaccatgcccagctaattttttgcatttttagtggagacagggcttcaccgtgatagccaggatggtctcgatttcctgacctcacgatctgcccacctcggcctcccaaagtgctgggattacaggcatgagccaccgtgcccagcctctttcttttttgagatggagtcttgctctgtcacccaggctggagtgcagtggcatgatcttggctcaatgcaacctccacctcctgggttcaagccattctcctgtctcagactccccagtagctgggattacaggcgtgtatcaccacgcccagctaatttttgtatttttagtagagacggggtttcaccatgttggccaggctggtctccaactcctgacctcgtgatctgcccacctcggcctcccaaagcactgggattacaggcgtgagccaccgtgcccggacgatggcaatttcttaatttgaaaaaatggaatgaagtagactagactaggctggaagaaattatcataatgtactgctccttatgcagataaacattgtctcaagaaatttttcagttaaaaatatgtaattcttggcaatactacccaaactgatcttcagattcaatgcactcactctcaaaatcccatctgcctttttggcaaaaattgacaagccgatcctgaaattcttatggaaatacacaggacccagaatagtcaaaacaatcttgaaaaacaacaaaattggaggactcccactaccccatttcaaaagtaatatgaagctatactaattaagacagtgtggtataagtacatacaaagatactaggataagggtagccatatagattaacagaatacaattgagaatccagaaataaacctaaatatgtgattttcaaaaaagggcatcaggacaacgtaatggggggtagagtcatcctttaaacaaatggtgatgagacaaccgaaagtccaaatgtgtggccaggcacggtggctcacacctgtaatcccagcactttgggaggccgaggcaggcagatcacctgaggtcgggaattcgagaccaatctgatcaacatggagaaaccctgtctctactaaaaatacaaaattagccgggcatggtagcacacgcctgtaatcccagctactcgggaggctgaggcaggagaatcgcttgaacccaggaggcagaggttgtagtgagtcaaaatcgcgccattgcactccagcctgggcaacgagagtgaaactccatctcaaaaaaaagaaaaagtccacatgtaaaacaatgaaggtggacccctacctcaaacattaaaatcgatcagagacccaactttaagagctaaaactataaaattcttagaagaaaactgagagggggtaaatctttatgaccttgggttaggcagtggtttctaagatatgacaccaaaatcacaagcaaaaaaagaaaaacagacacatagagactttaacaaaaattaaaactttcttaactgcaaaagacacaagcaggctgggcgcagtggctcacgcctgtaatcccagcacttcgggaggccaaggcgggcagatcacaaggtgaggagatcgagaccatcctggccaacacggtgaaaccccgtctctactaaaaatacaaaaatttagccgggcgttgtggcaggtgcctgtagtcccagctacttgggaggctgaggcaggagaatggtgtgaacccgggcagcggagtttgcagtgagccgagaccgcgccactgcactccagcctgggtgacaaagcaagactccgtctttaaaaaaaaaaaaaaaaaaaagacacaagcaaggccaggttcggctcacacctgtaatcccagcactttgggaggccaaggtgggcagatcacctgaggtcgggagttcgagaccagcctgaccaacatggagaaaccccatctctactaaaaatacaaaattagccaggcgtggtggtgcatgcctgtaatccctgctattcgggaggctgaggcaggagaattgcttgaacccgggaggcggaggttgcagtgagccaagatcgcgccattgcactccagcctgggcaacaagagtaaaactgtgtctaaaagaaaaaaaaaaagacacagcaagaaagtgaaaaagaatcttacagaaagaggaaaaaatatttgcaaattacataccagataaaggactcgtgcagaatatattaaggactcttacgactcaacaatataaagacaagtaacctaattaaatgggcaaagaaagctggatgacccagcacatgcctctagtccagctactcaggagcctgaggcaggagtatctcttggaatctgaggctgcagtgagctatgatcactcttattaagaagccactgcactccagactgggcaacatagcaagacccagtctcggccgggtgcagtggctcacgcctgtaatcccagcactttgggaggccgaggcgggtggatcacaaggtcaggagatcgagaccatcctggctaacacagtgaaaccccatctctactaaaaatacaaaaaattagccgggcatggtggtgggcgcctgtagtcccagctatttggaggctgacgcaggagaatggcatgaacctggcaggcggagcttgcagtgagccgagattgcaccactgcactccagcctgggcaacagagcaagactctgtctcaaaagaaaaaaaaaagacccggtctcaaatataaacaaaaaaatgagccaagaatttgaatagacatcactgcaaagacagcatacaaatggccaacaagcacatgaaaaggagttcaacatcatcagtcactagggaaatgcaaaccaaaaccactgcacacccattaggatggctataatcaaaaaaagcagcaataacagttgtcagcaaggacacagagaaattggaaccctcatataattctggagaacctactttgtaaaatggtttggcagctcctcaaaatgttaaacatagaatcggccaggcatggtggctcacgcctgtaatcccagcactttgggaggccaatgcgggcggatcatgaggtcaagagatcgagaccgtcctggccaacacggtgaaaccctgtccctactaaaaatacaaaaattagctgggcgtggtggcacgtgcctgtagttccggctacttgggaggctgaggcaggagaatcacttgatcccgggacgtggaggttacagtgagctgagatggcgccactgcactccagcctggtgacagagcaagactccgtctccaaaaaaaaaaaaaaaaaaagttaaacatggaattaccatatgatccagtaattccacttctatgtatctaccaacaaaagtaaaaagatgatcacacaaaaacttgtattcaaatgttcataacagcattatttataacaggcaaatgtgaaaataacccaaatgtccatcaactaattaatggataaacaaaatgtggtatatccatacaatggattattcagcaataaagtggaggtactgacacatgctgtaacatgcataaaccttgaaaacattatgctaagtgaaaaagcctatcacaaaaaaccacatttttttttttttttgagacagggtctcgctctattgcccaggctggagtgcagtagcatgatctcggctcactgcaacctccaccactcgggttcaagcaatacccccacctcagcctgcctagtagctgggactacaggtgcgcgccaccatgcccagctaatttttgtattcttagtagacgcagggtttcaccatgttggtcaggctggtcttgaactcctgagctcaggtgatccccccaccttggcttcccaaagtgctgggattacaggcatgagccactgtgcctggccaaaaccacatattgtatgataccatttatatgtccagaagagaacatctatagaaacagactgcggattagtgttgccagaggctgggtgaaaaggggagaagggagagtaaccactaatgacagccagatggtagtggttatgaaactcagtgaacatgctaccaactactgaagcatatcctttaaacaactgaattttatgtaaattatctcaatgaagcttccttatgtgttattctggatgtagggaatccctctcccgccatgcccacagaatctcgtctggtttcttttccataggatagtatgaataattaacctttctaaatcaaaggccttacttaaaggtctatatcaatttagggcatcataaccaaaatttttatcatgaaatccgcatagaaaatttcagagtacacggcctaaaaggttatctggctggatgcagtggctcatgcctataatcccagcagaggcgggggcaggaggatggtttgaacccaggagttccagactagcctgggcaacatagagagacccctttcgccacaaaaagaaaaaacaaaggttatgtggtgtggtatgaaacctttttatttttttgcccaagctggagtgcagtggcacgatctcggctcactacaacctccgcctcctggattcaagcaattctcctgcctcagcctcctgagtagctgggattacagctgcctgccaccatgtccgactaatttttgtatttttagtagagatagggtttcaccatgttggctaaactgttcttgaactcctggcctcaagtgctcaatccacctcagcctcccaaagtgctgggattacaggcatgagtcaccgcgcctggccttgaaacttttgtctgagatacatacatacacacatacacacacacacacacacacacacacacacacacacacacagagatgaatataaatagagagaagtgggtcagtcaaaacaaaaagtctggaaaatatattttagcagttgaccgtattcaagaaataaaacagtaagtgtgagatctcagagtcaaaaagagaaatcaaaaaaaaaaagctgaagtcactttaaagcatcattgtaagcaatggaactaaacaccagaaaaagtatatttgaccctggtatctactttggtaagtcaagtaataagcttccctcctccatccacctctcagggttcagaggagcttcctactcccactaaattcaggccccttctggtgaagtctactgtagatcacatgtggagctccgcagggaagggtgtaccatcactggaaatggggactgcagggctgcaggtgggcagcgtggacatgcaggccccaaactcacactaggggtccagaagcaagtgcaaaaagaactcaaacagaagccaagggtcaactggaggaaagaaaggagaaggaacaaaatcgatattgctaacttattcagtttatctttgagtggatgaaagaataaaggaagaggaacaaaaacccatcaaacttctctgagggagacaacattttcaaacactgcaggtcaggatctttgacacagaagatgcgagcagctgcacaatccaacagccggggctaaaacagaagccctggggacaaacctgaagaacgatcactcgtgaaactcctcgcagcaagaaatctgaggtcatcttcaaatcagcagggaaacaaaaatttagagaattatcactctcagggagagactaccaagaatatctgtgaggattgcagggtcaatgtcaagatgctgggctttgttcgctaaaaaaaacactatgtggccgggcgcggtggctcacgcctataatctcagcactttggaaggccgaggtgggcagatcacgaggtcaggagattgagaccatcctggctaacacggtgaaaccccgtctctactaaaaatacaaaaaattagccgggcgtggtagcgggcgcctgtagtcccagctactcgggaggctgaggcaggagaatggcgtgaactctggaggcggagcttgcagtgagccgatcacgccactgtgctccagcctgggcgacagagcaggactccatctcaaaaaaaaaaaactatgtatgagactgtaatctgtaattaggacacttcttgaataccactaaagaatatttacaatattgcaattgagtaaaaattgaaaataaaacctatgacagttaaacctattctgcaagtactccacgatgcattaaaaaaaaaaaaaaaaagttggccatgcgtgatggttcacgcctgtaatctcagcactttgggaggccaaggcagacggatcactcaaggtcagcagttcaaaacaagcctggccaacatggcgaaaccctgtctctactaaaaatacaaaaaaaattagccaggcctggtggtgggcacctgtaatcccagctactcaggaggctgaggcaggagaattgcttgaaccagggaggcggaggttgcagtgagccaagatcacaccattgtactccagcttgggcaacaagagcaaaactccacctcaaaaacaaaaagtagctgaccgtgtgtggtggctcacgcctgtaatccctgcactttgggaaaccgagggggggccaatcacctgaggtcaggagttcgagatcagcctggccaacatggtgaaaccctgtctctattaaaaatacaaaaattggctggacacagtggctcacacctgtaatcccagcactttggggggttgaggcaggtggatcatgaggtcaagagttagagaccagcctggccaacatagtgaaaccctgtctctattagaaatacaaaaatttgccaggcatggtggcacacacctgtagtcccggctactcgggaggctgaggcaggagaatcacttgaacccaggagatggaggttgtggtgagctgagatcgcgcccctgcactccagcctagcgatagagagagacttcgtctcaaaaaaaaaaaaagaaagaaagaaaaaaaaaattagccaggtgttcaggcacctgtaatcccagctactagggaggctgagacaggagaagcgcttgaacctggaggtggaagttgcagtgagccaagattgcgccattgcactccagctgagcagcaagagtgagactctgtcaaggaaagggaaagggaaagggaaaaggaaaagaaatcgctaactaggccgggcgcggtggctcacatttgtaatcccagcactttgggaggccgaggcgggtggatcacaaggtcaggagggagttcgagaccagcctgaccaatgtggtgaaaccccatctctactaaaaatacaaaaattagccgggcatggtggtgggtgcctgtagtcccagctactcaggaggctgaggcaggagaatcacttgaacctgggaggcagagcttgcaatgagccgagatcgctgctgcactccagcctgggtgacagagcgagaccccgtctcaaaaaaaaaaaaaagaaaaagaaatagctaactataggaaggaggaaaaaaaaagacaaaatgatcatttgcagctacaagttaagtattccttgtataaaatgcttgggaccagaagtgtttcaaattttgtatcttttctgattttggaatatttgcatatatatatagtgagatatcttgagaatgggaccgaagtctgaacacaaaattcatttatgtttcatatacgccttagacacatagcctgaaggtaattctactcaatattttaaataattttgtgtataatggccaggtgcaacggctcacacctgtaatcctggcactttggaaggccaaagcaggaagatcgcttgagcctaggagattaaggctgcagtgagccatgatcttgccactatacttcagcctgagtgacagagcaagatcccttaaaaaaaaaaaaatttgcatatgaaataaagttttgactgcaacccatgacatgaggtcaggtgcggaattttccactcgtggcatcctgtcagtgctcaaaagtttcccattttagatttggggattagaaatgctcaatgtgtattatgattacctatctaagaaactcaagagaatctactgaaaaataagaacaacagagtttggttaagtagcatagcagacacggtgctattacattttcctcacggacacaccaaaggactccacttcccagcccccttgcacctaaaatacagccaacagaccgcagaagaaatactactacttccaagcttggcccatgaaaaaaacttccatgcacaaaattacacggcaaacttaaggtcacatcttcttgtcagttgtgacaaaaatggaaggagcccagatccccaagtcaccacttagaaaagaaccatctaaaaaagtgtgagcaagaaataaatgttttctttgtcaggccacagattttaactagcattacctaccctgactaatacaggttataaaacatacagactggccaggtgcagtggctcatccctgtaatcccagcacttcaggagaccaaggcagaggattacttgaggctgggagctggaggccagcctgggcaacacagcaagattccatctctagcttattttttattttattttatggttttttttgagacagagtctcactcagtggcctgggctgaaatgcagtggcgcgatctcgactcactgcaacctccgtttcctgggttcaattgattcccatgctactcagcctcctgagtggcagggactacaggcatgcaccaccacaaccagctaattttttttttttttaatagagtgggggtttcaccatgttggccaggctggtcttgaactcctggcctcaggtgatccacccacctcggcctcccaaagtgctgggatttcaggcgtgagccactgccccggcctccatctcttatcttattataaaaacaaggccgggcacagtggctcacgcctgtaattcccagcactgttggaggccaaggcaggtggatcgctagaggtcaagagttcaagaccagcctgaccaacatggtgaaaccctgtctttactaaaaacacaaaagtggccaggcatggtggaacaggactgtaattctacatcggaggctgaggcaagagaatcacctgggagaaggaggttgcagtgagctgagatcgcaccactgacgccagcctgggcaacaagagcaaaactccatctcaaaaaaaaaaaaaaaaaaaacaacccacagcatacaaactgcaagcagtatacttgctttatacctgctctataccagttagtaatagcgggtgggagggaggtgtgaggggagataatcgcattctaaataccaaatattttctttgtttttgagcagggtgtctccctctattgcccaggctggagtgcggtggcaccatcacaactcactgcagccttgaactcctgggcttgagttctcttcccacaatcagcctccctagtcagtgggaccacaggtatgcacaccaccacgccaggccactttaaaaatttttgcagacatggggtctcactacgtttcccaaactggtcttaacctcctgacctcaagcaatcttcccatgtcggcttcccaaagtactgggattacaggcataaatcacatgtccagtccagcaaatactttaaaataaagaataagtaatcagccaggcatggtggctcatgcctctaatcccagcactttgggaggccgaggcaggtggatcacaaggtcagcagttcaagaccagcctgaccaatacggtgaaaccccatctctactaaaaatacaaaaattagctgggtgtagtggtgcacacctgtaatcccagctactcaggaggccgaggcaggagaattgcttgaatccaggaggcggaggttgcagtgagctgagatcacaccactgcactccagcctgggtgacagagagagactccgtttcacacacacacacacacacacacacacacacacacacacacacaaaagtaatctatagaccacatattaggaaaaatctagagacactgactttttctgttcatacacagaacaagtcaatattataaagatgacaagtctccccaaattaacttatgcatttaatgaaatttcccattaacagtattttgacagcctggccaacatggtgaaactctgtctctactaagaatacaaaaattagccaggcgtggtggcacatgcctgtaatcccagctactcgggaggctgaggcaggagaatcacttgaacctgggaggcagaggttgcagtgagccgagatcgcgccattacactcaagcctgggggacagagtgagactccatctcaagatggagggagtattttgaaaccctaaattgaaaaacactggagtaaaaactgagcataggcactaccagataataaagcctactataaagtgattttaatgtctaaaatagtaaggtcatggcaaaagaacagataaactgactaaaacaacagatccaaggattcagcatatgattaaggtgttattttttaagttaataaggatgaattaatagtacccaaaaaatataaactagaggggacaaataatccttacttcataccatactccaaaacaaatatcagactaattatagccaatttttttttaaagaactaagagaaaacatgagtgaatacctataaaatttagggataacaaagccatgggaaataaaaaaagattgacagtttttttttttttttttttttggagacggagtttttcgctcttgttgcccaggttagagtgtaatgaggcgatcttggctcactgcaacctccacctcccgggttcgagtgattctcctccctcagcctcccgagtagctgggattacaggcatgtactaccatgccgggctaattttgtatttttagtagagacggggtttctccatgttggtcaggctggtctggaactcctgacctcaggtgatctgcccacctcggcctcccaaagtgctgagattacaggcatgagccaccgcgcttggccaacagacttgaatttaagtcaaggcatagaaaaaaatatttgcaaagtaggacaaaaaaatgcaaatcttaacacaggttgagtattcctaattcaaaaatccaaaatttgaaaggatccaaaatttgaaaggctccaaaattcagtactttctgagtgccaacaagacactcaaaagaaaatgctcagcctggcgcagtggctcatgcctgtaatcccagcactttgggaggccgaggcaggtggatcacgaggtcaggagatcgagcccatcctggccaacacagtgaaaccccgtctctactaaaaacacacacacaaaaaattagccaggcatggtagcgggcgcctgcagtcccagctcctagggaggctgaggcaagagaatggcatgaacctgggaggtggagcttgcagtgagctgagatcgtgccactgcactccagcctgggcgcgccactgcaccccagcctgggcgacaaagcaagactccgtctcaaaaaaaaaaaaaaaggaaacgctcactgaagcattctgaatttcagattaaaaaattaggaatgctcaactggtaagtatagtgcaaatatgccaaaatccgaaaaaaaaaaaagaaaaaaagaaacccaaaatccaaaacactttctagtcataagcacttcggagaaggtatattcaacctgtacgtgtttctcaagcaggtcaagatcaaaaacaatgtatctagtagcatcaactttactcaaagaacatggaagaaaaatgttttatattaaaacaagcactgatgtttctgaaacagaatgagaaattcacattaattttagataaaacagaagagacttaaaagaagtgtcatgcttgttatattccaaacacttttaaatatgcatacattcccccatatcatgcatctgtggaaaaatttgtgaagcaatgtctataaatataaatatcaaaaaagctcttgataagaaatatatgaacttgggctgggaacagtggctcacggctgtaatcccagaactttaggaggcttgagctcaagagttcgagaccatcctgaccaacacaggagacccccatctctaaaaacatagtgaaaccctgtctctacaaaaaatacaacaattagttgggtgtagtggtacatgcctgtagtcccagctactcaagaggctgaagtgggaggatctcttgagcccgggaggcagaagctgcaagtgagcagagatctcaccactgcactccagcctgggtgacagaccctgtctcaaaaaatatagatacatgaattcaatagaaaattctcagcactgaccacatataccttactgtgaagcaggatcaccaaactttttctgtaaagggccagagttacatggtctcttgagtgagcttggctgtgttgcaattaaaccttatttacaaaaccagatgctggtgatgcctccaccagcaacatccctgtcacctgagaacttgtgagaaatgcacattttcggggtccaccctagatcttcagaatgagatccatgtttgacaaggaaggtgttgtagttagcccccagctaggtgatctgcctttggagacaggaaatgattttagccagccctggagaggagtcaataaagccaaaccgaatttgaggctgaaatcccatctaaagtagaatgtataagaaattgtgttggccaggtgcggcggctcacacctgtaatctcagcactttgggaggctgaggcaggtggatcacgaggtcaggagttcgagaccagcctgaacaatacggtgaaaccccgtctctactaaaaatatgaaaattagccaggcgtagctactcaggaggccgaggcagaagaatcgcttgaacccatgaggcggaggtttcagtgagccgatatcgcaccactgcactccagcctgggcgacagagcaagattccgtccccaaaaaaaatatgaaaatacaaaaattagccaggcgcagttgcagtgaccgtaatcccaactactcaggaggctgaggcaggagaatcgcttgaacctaggaggtggaggttgcagtgagccaagatcgcaccattgcactctagcctgggcaacaagagcaaaactctgtctcaaaaaaaaaaagaaaaaagaaagaaagaaagcaattgtgtttccttcatgaagactgaggacacagcagtgctttcggtctgaagcagggtggagaagaccctcagagtcacaaagccaagaactctgagatgaaatgatggtccaaaatgaaaaagcttattcaaatttaattgaatggagctgggggtatgtatatattcacttgaacaaaggaaagccagtggggggaaaaaatgtgtgagcgttgaggtggtgggtagaagattcctacaggaacaaacaagggaattgacagaaagaatccaagctagggtgcataaaggcaaacactgtagccaggaatgaaccacaggcaaacaaggcaggagcaagaggagacggtcctgctcccattcagcctcagcctcctcccagtgcaccctttactccaccccaaaattttctaaaatgcacatctgaacaagtcactccccttctgggaatctccccgtgcctttccagacaaagattcaagccccataatacagtatcaaaggacctctccacctgacccccatcacatcctcagcatccttccaactgtcctaactcagttaccctctcccagtcacatgcctctcctgctccaccctttgctcacactgatccctcgatctggaatgtcattcccaacttctgtagcctaaccctactttctatcccaagtccccaaaagtcatcctggaacacagcatgattagagtctaacttcgagcttggcaactgaccggcctagggtcaaatcctgactctacttgtcagcgctaagaccctaggcaagaagctgccctcctgccacacctcagcatcctcagctgtaggatgaaaagcgttaatacccagcccacagggctgcagagactgatcaacgtgaaagaacacaggagtgctgggcagagctccctggcactcaactgacactggcttctctgccctcttctatactaacgagaacttagaaaccctgagtttcagatgagagctgggaatagtgttctacagtggtttaatggaacagaattcaagactcaggaattaacttacagaagttacccaagacttcatcaataaatgaaggaccagaagccaccttgcctgccagttgctaggactagcaataataacctaaagtgcccaatgcataatcaatacctatgggcaccatcactgtttccttggccctatcacatggggctctcttgtctttctagggtcccttctattgcttggagagggtccaacagagaagcgcaccttatcaaactgcacttccattcaacttagaagatagagggattcatctctgtaagagttacacacatagatggatgacctccaccaggtgctcaatgagatgatgcctttgggaaggaagcccgagccatcagctgctttgagcaaaactcatgagtgggcaaaactcatgagtgggccaggcacggtggctcatgcctgtaatcccagcactttgggaggccaaggtgggcggatcacgaggtcaggagtttgagaccaggctggccaacatggtgaaacaccatctctactaaaaatacaaaaattagccgggtacagtggtatgcacccataatcccagctacttgggaggctgaggcaggagaatcccttgaacccgggaggcagaagttgcaatgagccgaggtcacaccactgcactccagcctaggtgacagagcaagattccatctcaaaaaaaaaaaaaaaaaaaaaaaacaacaactcatgagtgaagattttcctgatcactgaccagagaaaaccactctcctttaaggatggaatttccatagagggccttagagacacctagatctgaggtcacagacttggctgaggtcacctgaggtcaaagtcgaaaattgggacaaaggacaatgagaagctcccaagatttatatttccattgaggatgaccttccccaaaaatctccacccttgcttttctgctgcatttgggtatgctgggttggcatcacaacttaacatggcctaaaccagctcctccagcatctcagttaatggcctctttctttctaggtgctaagaccagaacctcggagtcctcctcagttttctttctggttcatcagcaaatctcaacctcaccttgaaatcccactagtctcccctcagccctgcattctggctggtctccttgctgtcctgccttcaatctgtctcacacagcaacgcctagagtgtgcttgctaaaagctagatcagtccacctcccttctttactccaaaaccctccaatggcttctaccaccctcaaggtaaaatctaccagccttacagtggtccgcatggccttacatgatctgacccccatggtttctctgacctcaagaccaaattctcccctcctcctgcctcagggcctttgtatctgctgtttcctcccctcagaatgatccttctcccagatctccacatgcctcactccctacacatctttagttaaaaatgactcaagccctctgctatgaactcaactgtatcccccaccaccaccgaaagaattcattatattgaagccctacccccacaatgtggctgtatttagagatagagcctttaggaggtaaccaagtttaaatgagttcttaaggatggggccctgatccaataggaaaactttatttttttaaacaaagtagctttgtcacccaggctggtgtgcagtggcacaatcatggctcactgcagcctcaacctcttgggctcaagcaatcctcccacctcagcctcctgagtagctgggactacaggcactactaccacgtccagcgaattttttattttattttattttattttgtagagacagagtcttattatgttgcctagactggtctcaagtgatcctcctgcctcagcctcctgaagtgctgggattacaggtgtgaccaacagtgcttgaacagaaagataaatggcaccaagaaaaggccatgtgaggactcatcaagaggatggccacctacaagccaggaagaaagccctcaccagaaactaaagaggccagaaccttgaccttggacttcccagactccagaattatacgaaacaaatttccgttgtttaagccacccacactgtgctatttttgttatggcagtgttagcagactcatataccttcctccctgtctacccttccaaaaatatcaactcccatccccacacttaatcccccgagccttgtcagattcctcttcacagaaccagatctcattgtccacatccctacagtgtgggctccatgtgggctgggaatctccctgcagcatcccaagcaccaagaatattacccagcacagatcaggcactcaatgtaataaatgtatgaaaggcctatgaaaggtgcaagctgaaagcagacctcaattacaggagagccaagaacctagaacctgtgacgaaataacaggttcaaaatagcaaagccacagagaaaatgagaagaacggcatagcgcacaaagggctcgtttcaacctagaggctgcaatgcacagcttaacctggaggaggatggttccctacagaaagaataaaagcaagcccagagaacaactggaggaatagcagggcatgaaaatgaattaatgaggtgaggttactgggcactgggaaccaacagactggtgtgtgagagttttatgggcaaggccaggaaacggttcaggaaggactgtaagatgtttaaatttaaaaagcctaagaggattaaatataaatacgtttttaaaaagcttcaatttacatgtacaaagcaccatataatttcaaatcattactgttgatctttttttttttttttttaggagacagtctcactctgtcacccaggctggagtgcagtggcacgatctcgactcactgcaaactccacctcccaggttcaagcgattctcctgcctcagcctcctgagtagccggaaatacaggcatgcgccaccatgcccggctaacttttgtatttttagtagagacgaggtttcaccatggtggccaggctgctctcgaactcctgagctcaagcgacctgcccgcctcagcctcccaaagtgctgcgattacaggcatgagccaccatgcccagccccggcctactgcttttaattaccttaaccaaaatgggaaaattcctcaagctaccagtggtaccagaatataggtccccaaatagatccctggtttgtctttagagacactgaagaggacaacaatagccaattcgggatttcaaacaccccacaaactagaccttaggctctgtgagggcaaaagacacagtttattcaacaacgatctgttcaacagaacctggtcaccaagtggatggatggatgggcagacacagatggacagactactcagtgggtggctacatgtgcttgcctgccccgggacacatgactcacttctgcaatgctacatagactagagtttgctccatcaatgagatagatagtatggcatgaaacctagcaaaaccatctacatttttctagccaggtactggttttttttaagctggccgccatactcagctattttttttttttttttatagaaacaggagtcttgctgggttgcctaggctggtcttgaactcttggcctcaaacaatcctcccacctcagcctcccaaagtgctgggattacaggtgtgaaccacaacacccggcccaggtacttcaataggcattttttaaacatgtcaacagatgtttaaacttaattgacttaattgaccgtgccacagtcagagaatacaactgccagacaaccatctaaaatactgtcaacataaaaagttcctgaaatacctattgtcttaaaaaatcaccctccactctaagcaaagaaaccaaaagagaaatgccttggtattaaaagaaagaagctggttgccattttggcaaaggaaatagcctagaaagcagatacctcatgctcaggatgtcacatggaacaggctggacacacctgctgcctccctttaactagcaggtgtgccatgagagcttacactgggcacacccactggtgcccaaaagccattaaattggggatgaatgaaaagagaacagtagtaatacgttcataagtgaccctgatagagccaaccataacccagcacagaattctgattttttgagctgaaaagggccctttatacatctcaccaggttcaaacaccttcaggggaggcaggcaacgtcacctgcaacggtgaaaaaggcaggtgtagacaaccagaaacggtgaggcccaaacccaacagcattcaaatacaaaagcataaaataaaaatgctccagccaccccaattccagccttttgcttcagagaggacgaagccggctgagggaggtcacatggccaattagtgacagctcaaaccagactgcctccggactcccagtcccatgtcctcgcacatcccggggccttctctgcgcgcagatgacccaattgtcagcagggactgcatcttcccccgcccgtctcccagcactgcaagaatagaagtagcacctactacaaacgctgcagacccagaaagcccttatgggtgactttcttccacctgcagttgccctcatttaccctttgccctgacaatcgataatttcccatcagtcacgcttaaacccccagcctgcaggccgacatcctatcagccacccatccaagggggggcatctaggaccaaacgaaggagaaaatcctgcgccttaaagtagtcacactcgaaatgtcattttttccccccgaaaggtggcaaggagggggactcgcgaccccccagggaacaggccagaaaggccccggggtcggaggagctgcttctaaaattacttcgcgcagtctttgtagaagggaagaaagcaagaatgtaaaaggcaccctcttgccgcccctcctgatgcccctgaattccagggggcgagacgatgcccgtgcgcaccaccgggggaggggcgagggaagcgaccccaggacgcgcgggcgcagagcccgggaggaggcggcggcagccagtggggttctgggggcgccccatttgcctccccgctgcgcggcctgagggcccgagcgcgctgtggctcccgtggcgggaaggggtgggtaccccgggggcccggcccggccggcagaacggcaggagctgagggccgccgggcatcttgggccccggggccagggtggccggcgggcgcggggtcccgggagatgggtcggggtgggggcgcgcaggccgcgccgcggggccggtgggtgacagcgcgcgggggccgtgccaggccggcctcgtgggcgcggcgagcacctcgcggccccgccggcaggtgcggcccgcaggccgggcagggggcgcggcggccgggctctcacctggctgcagctcgcgtggttcccgtcctgccgccgcgcctcggcgccgcagtgcccgctgcagcctccgcctccggtccccgcgacagccgcctgcaaaatggcgccgcggaggggcgggccgggggcggggtgcagcggagccgcccgcccccgcgccggtctggggcccacctccctccccgcccccgacccctgccctcgggcctccccccggggaggggctgctccctggcacccggcagcgctccccggaacatcccgggcctcgcacccagccgtccccttcccgttcctttcatttccctcccctgcgcagaaagatcgccccccttcgcgacccttcccaccagtcacacctgttcctggggacccacctggcaagcagagcgctggtccctgagtgtcctggtccaggtcccccctttttaccccgcctgccaccgagccctgtcattgctcgagcgtgataagcaagcagtttgtggtgcattgggctcagtgggttggatgttttaaaacaatttcaccgcttctccacttaggtagccagtttttttaacctaactggagaagaagtccttcttacctcatgcagagatcgtaatacagaccaaggcttttcagacgtgaattctctgggggtcgtgttaggctaggggcgggttcacattcagtggctctggggtgcagcccaaaagtctgcacttctaaattgtccccaggtgatgcccccgggtgaggttcttggaccgctaagcagaaaggccaagtgtaaatccctggccctcggtcttagagctgggcagcctcactttgaggacttcattaagatgcagatggctgggccccacccccagagttgctaaggctggaggtctggcgtgaggctccagaatctgcatttctgccaagttcccaggtgatgctgatgctactggtctggggaccacacgtattgagccactgctgaaatctgaatacaattttttaaatgttctaataattagtactttcttaacaccttccatcttgaaaccgttgtcatggttgctttactaactgaatgataatgtactagttcccgggcaactcttgagaaacagaattgtagacggtgtctgtctgacctcacatggagagaaattgattttataatcagaattatttatgtgttttacacagttttggaaagtgacatcacacatattaatgcagttgggggagcagcaactaaaggaattttatgaaataggcaagtgtggtctgtgtcttgacaataatgtgtcttcccatttatttatctaataactgcatttttatttgcttatatttaattttttagagacaaggtctcactctgtcacccaggctggagtgcaacggcacaattaaggctgcagcatcaaccttccaggctcaagggatcccccaaccttggcctcctaagtagctgggatgacaggaccacaccaccaggtccagctaagcttggttttatgcgtcacgggcgcccatccttaaccttgacaaaatgaaccttctaatttgactgagacctgtctcagatatttgaagttcacaatccctactgggattcagtaagtagggaaaagaaagtgttggattgcaaaattcaataatgtcgaatgttttgatccccgttgaagatggagaaaataaaaaacaaagatgcggccgggcgcggtggctcaagcctgtaatccgagcactttgggaggccgaggcaggcggatcacgaggtcaggagatcgagaccatcctggcaaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccaccgcactccagcctgggcgacagagcaagactccgtctcaaaaacaaaacaaaacaaaacaaaaacaacaacaacaaaaatgctgtgaccagcacccagagaaaaactcacgcattgccccgtaaccatcattctacaccagtgagagcatagagcgtattccagccaaccttttttttttttttaatacgatgtgtttgcttagcaaggaatgtggagtcttctgattagaagggaagggaagttccagggtcaagaccccctgagcttttaagtctatcccctccccatcgttattccatgaactgtggaatcttcagtgtctccctctccctctctaggcatttaccatttttctctatcctgaaaaaccttccatagtcccagtctgcccagccgtcctgcctgccttcctctgcccaacctcccctgccatcacccctcaggcactgtccctccctgttttatcagatgtcatctgtgaccttctaattgccaaaaccaattacaggtttacagtccttttcttctttgatggctctgtaacagtccactgacttctcactcgaaattctattcttgtgataataccactgtttcttgctaactatccatacaccccccttccctctcagtgatgtgagtttctcagactccagtctagaaatgttagtttcccctcatatctcctttctcccctgccctctccttctctaaccccctctgaaggtcagccatctcctcgtggttcccaaacctctctccctagacaagacagacatctttctgaacttgtagacacatttccaattgtcccttgaacaacctgccctgaatattctccaggaattgcaaataatctccactattgatgcattattttctcccataaactggtttcttatctgagttctctcattttgctaccagaaacttcaaactggtctttgagtccttgccccatagcctacatgtccactctgtcacctgtggtcaagctgggaagtatttctgaaattctcttctcatccaacacagatactgaccctcactggctctttcttggactgttaaccatcgaaaaagtttctctctggcctgttggactcaagactaatctcctgaaactatccttgttatcatcccagagcacagaactgataatctcacaccttttctgaaaatccttcagggcctcccagtcaaaaggataattggagaccaggcacagtagttcacacctgtaatcccagcattttgggagaccaaggcaggaggatcgcctttgccaggagtttgagaccacactaggcaacatggggagaccccatctctgaataaataaataaataaattaattaattaaaagtttaggccgggtgcggtggctcacgcctgtaatcccagcactttgggaggccgaggcaggtggatcacctgaggtcgggagttcgagaccagcctgaccaacatggagaaaccctgtctctactaaaaatacaaaattagccgagcatggtggcgcatgcctgtaatcccagctactcaggaggctgaggcaggagaagcgcttgaacccaggaggtggaggttgcggtgagccgagattgtgccattgcactccagcctgggcaacaagaatgaactccgtctcaaaaataaataaataaataaataaataaataaataaataaaaatttaatagctaaataaagaaagaataaacctttcccagtgtagcattcaaggcccttaatctctagtctcggcttctttttcttcttttttttttggagattttactgctgacaaactggctttggtatcagcagatagctctgacttctgtctttcaacgtcttacaaggattaaatgtatataaagtgcttattcagtgcatgaatatgtaggtgttcgatatcattatttttacataattatttttaccattatcatcaattaaaaaaatacatcaaatttttcctcttcagttgcttttccttttattttccattcatcttcctttctattacagctcatacaaacaaggtttttttttcctcctcccttaacttctctaaactaaatcagcagaatatatcaagaacgtttcatgacctggttaatttgattgaaatttcagtcatttccaggctgtgttatttttgagaggtaattgtagcttggggctattccatcttcatacagtacttttcaatgttattttcaacatctctctggagtctagacctggggcaaacgttttctggaaagagctagataataaatgttttaggttttgtgggccaagaggtaaaattgatgacattatataggtacagtacttatataatgataggggccaggcgccgtggctcacgcttgtaatcccagcactttgggaggccgagatgggtggatcacttgaggtcaggagttcgagaccagcctgaccaacatggtgaaccccgtctctactaaaaatacaaaattagccgggcatggtggcgcatgcctgtagtcccagctacttgggaggctgaggcaggagaatcacttgaacctgggaggtggaggttgcagtgagctgagatcgcaccattgtactccagcctgggcaacaagagcgaaactccgtctcaaaaaaaaaaggtgacagtacttatataatgatagaaaacaaatttccacagatttcttattgatgaaattcaaaatataataatgattgagcataatatatttttttgtttgttttgttttgttttttgagatggagtctcactctgtcgcccaggctggagtgcagtggtgggatgttggctcactgcaatctcctccctctgagttcaagcggttctcctgcctcagcctcccgagtagctgggattacaggcgcctgccaccgcacccagctaattttttgtatttttagtagagacagggtttcaccatcttggccaggctggtattgaactcctgacctcttgatccatctgcctccgcctcccaaagtgctaggaattacaggcgtgagccaccgtgcccagtcatattgagcataatatttttataatacaggtctactaatgaaaataatagaatttggggggtggggaaaataagattttgcttacttggggttcaaagttagtctttcctatcatcaaattgatggcaaatgttcatctgtaaaagccattttatttatttatttatttatttatttatttattttgagacggagtcttgctctgttggccaggctggagtgcagtggtacaatcttggctcaagcaattctcctgcctcagcctcccaaatagctgggattagaggtgtttgccaccaccccccactaatttttgtaattttagtagagacagggtttcaccatgttggccaggctggtctcaaactcctggcctcaagtgaaccacctgccttggcctcccaaagtgctgggattataggagtgagccaccactcctggcctgcaccatctcttgatgtcagcagaattcacactttctacatctgtctcatactaagacataacagatctagggctgcgtggcaggaccaagacctgcctgaaatgacgtgtgtgtgtgtgtgtgtgtgtgtgtgtgcgtgcgtgcgtgttcaatgatgtgcattgaagcattgtttcaagtagcaaaacaaaaacaaaaaacctgaaaacaacctaaacatccatcgatcagggaatggctgaatgatctatgagataggcaccgtatagcatgtataccacgtaggcttctccccactccaccgccaggcttgcttttattttttttgaaatataattcatgtacccataatactcccattttaaggtatacattttagaatatatcatttaaagtaaacaattgtggccatgcctggtggctcacacctataatcctagcactctgggaggccgacacaggtggaccacttgaggtcaggagttggagaccagcttggtgaacacagtgaaaccctgtctctactaaaactacaaaaattagccaggcatggtgacatacacgtgtagtcccggctacttgggaggctgaggcaggaaaatcacttgaacctgggaggcagaggttgcagtgagctgaaatcgcaccactgcgcaccaacctgggcaatagagcaagactcagtgtcaaaaacaaacaaacaaaaaaagtaaacaattgtaaagtatacaatttggtggttttcagtatgttcacaaagctgtacaagtaccactaattttagaacatttttatcactcctaaaagaaactccatatctattagcagtcatttcctatttctcctcttcccccagccccggcaaccactaatcttcactctctttctatggatttgactattctgaacatttagtataaatggaattatatgaattatatactaatatgtggtcttttgtgactggcttctttcacttcccatgttttcaaggttcaactacattgtagtgtgcttcaatatttcattccttttttcattgtgataaaatatatgtataataaaattaactttttttttttttgagacagagttttgctcttgttgcccaggctagagtgcaatggcatgatcttggctaactacaacctctgcctcctgggttcaggcgattctcctgcctcagcctcctgagtagctgggattacaggcatgcgccaccacacccggctaatttttgtatttttagtagagatggggtttcaccatgtgggtcaggctgctctcgaactcctgacctcaggtgatccacctgccttggcctcccaaagtgctgggattacaggtgtgagccaccacgcccagccaaaatttacctttttaaccacttttaagtgtaccactcagtggcattaagtgccactccagcctgggcaacagagtgagaccttgtctcccccacaaccccctaccccttgaaaaaagagagcgtttaaatgcacacaccctgaactcagaatgttagttctggaatctgtctgacacaaaagcacactggtgggcacggatctatgcccaaggggctcaaagaagcagggtttgcttctgcctcctccaccccagttcactctgcagctccggcagatctgaagcccagctaatggaagtaacctcttaccctcgaatgaccccaaattccttacctaaccattctcccctactcccagcaaataaccttgcttcctgatttttggcaactggtcatgagaagggcatttcctcatcccccacctccccttatccacgaccccactttcccatgagggacctctcttccctgcctcgagtactgaagacccctcctttgggtgtcctccatatttcaatgctgacctccctttctttattttttcttaagatgggtatgttgcccaggctggtctcgaactcctgggctcaagtgaccctcccgcctcagcctcccaaagtgctgggattgcagacatgagtcaccacgctcggccctaccacccttgtctttggaaagtttacatcctcccagttcccacaatcatctccccttctcagctcagcttctcaaaaaagccacgtacagtatttatttcctcctcctcacttccttcctccctttaccccaggcaatctgggctgcattcttgtattcctctgaaactgcccaggtaaattagccatgccctcaaaattgcacaatccagggaatcttttgcatatgcatcttaattttctggaggcatttggcacagctgtattctctcaggataatctctcttcttttgactttgtgactgcatttcctagtggttcttctacttctctgactgtatttttttctttcttctcagattcttcttcctcctgctcccttcaaaaaaggtgttggggataaggagagtgtggctatgtccatttctgttgtccctgcaaaagctcctcaaggccatcacatttctactgcctggatctccttaatgtcctctggatcattcttgctcagaaagtcccaccttggcctctcctggaaccaccccgagtccctaggctggtgcaagtatactccctccatgcatcacagcatttagaaagaaatgtatggaaataagttgtttttctgtttctctccctcactaattgtcagtgcatccagggcagaggtcttggtttatttaattctgtatgccagctcctcacgtggtgcctaccacacagtaagttctcagttcggttactactgaagtactcagttagtactcaatgactttacttgttccaccaaaccaacaggggctgcccgctgatgagaggtgaaatgcgaagggaaagaactcaggattaacccccagggttctggagaattggaaactgaattagtcaaggttctccagagaaacagaaccaacaggatatatagagggatatataaaaggatatgggccaggcgcggtggctcacgcctgtaatcccagcactttgggaggccgaggcgggcggatcatgaggtcaggagatcgagaccatcctggctaacgtggtgaaaccccgtctctactaaaattacaaaaaattagccgggcgtggttgcaggcgcctgtagtcccagctacttgggaggctgaggcaggagaatggactgaacccgggaggcggagcttgcagtgagccaagatcacgccactgcactccagcctgggcgacagagtgagactccgtctcaaaaaaaaaaaaaaaaaaagaggatatgaaagaggggatttattgcaggaattagctcacgtgattctaaaggccaagaagtcccaccgtatgccgtctgcaagctggggaacctggaaagctggtggtgtccttcaccctgagtctgaagatctgagttcctggagctgtgatgtccaagggcaggagaagatgaatggccctgctccagaagagggtgcaaatgtgccttcgccctgcctttttgttctgtctggacccacagtggattggatgatgcctgctcacgtgggtgaaagtggaacttttctgtctactgatttaaatgcttatctcttctgcaaacaccgtcccagtcagacccagaaataatgttttaccagctatctgggcatctcttagcccagacaggttgatacatataattaaccatcagataagccaagtggaaaacataggttacaggcaaaacacagaaggctccagtgccagggtatagaaatgagacttttgggttgggcactgtggcgcagacatgtaatccagcactttggaaggctgaggtgggtggatggcttgagcccaggagtctaagcccagcctgggcaacatggtgaaactccgtgtctatataaaatacaaaattagccggccgcgatggcttacgcctataatcccagcacttagggaggccaaggcatgcagatcacctgaggtcaggagttcaaggccacctggccaagatggtgaaaccccatctctactaaaaatacaaaattagccatgcgtggcggcatgtgcctcccaactactcgggaggttgaagcaggagaatcacttgaacccaggaggcggaggtctcagtgagctgagattgcaccattgcactacagcctgggcaacaagagcaaaactccatctcaaaaagaaaaaaaaaaaattagctagtcatcgtggtgcacgcctgtagttccacctactggggaggctgaggtgggaggatcatttgaactcgggaggtggaggttgcagttagccgagatcgcgtcagcctagcaggctgggagacagaacaagaccttgtcaagacagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaggaaagggagggaagcttttttcaataagggaatttaacctagaccctcatggacacacttagtctttgagggggaaataaggaaaaaggacaaaaatctatcagtagttatataaagtagaaaagaggttgaatgggagggacaggtaaaatgaaaagaaaaagaaaagagtttcaaacaggaagtggatgacagcaaatttgttttgttttgttttgtttttaaagaaaagaggcaaacaaaactgttggaatttgggatactgtcaccctctgggggcatagtgactaagcaaaggcacaggggtcttctgaagagctggccatgtgtgatgtcttgctatgggtgctaggcacacaggcatattcactttgtgagatttcattaacctgcacacttaagtgtgtttctctgtatgtatactacaaaaagttgttttttgtttttttttttgagatggagtttccctcttgttgcccaggctggagtgcaaaggcacagtcttggctcactgcaacctccacctcccaggttctagcgtttctcctgcctcagcctcccgagtagctgggattacaggcacccaccaccacgcctggctaatttttgtgtttttagtagagacggggtttctccatgttggccaggctggtctcaaacgcctgacctcaggtgatccccacctccccccgccccgtctcagcctcccaaagtgctgggattataggtgtgagctaccgcggctgggcttgttccctgtttcaaacagcttggtctctgtctgaggtggggcctggggcacaagaaaaggctcagggtcttgaatgggtcccaggtgctgtctccaggaatgtgtgccttagaaaagagggatgtgtctgtactgcaggatgtgaaggtttaagtttgaatatttctttgatcctagaataaatgagttatacacctcatgcagccttggcgagaaaaggcacagggtccctggcctgcctctgccttgctcagtgaccttggggaaatcatataaccaaactacatttaggtttcctagtatgtaaacttaagacaatttcgtctgccctatccactgcctaggttggtatgaggattaaatgaggtaattgatgtgaacgtgcttcctgcagatgtttttttatagccctttacaaataccatataagaagcctaatctagctgtagaattgagcccacaattggtttttgagccataatatcaaacactcagtctttccctaggtgatatttttccattctctgtttttgataaggtctctagtttgtaaggtcacttggaattcgagtcctttgtgcccagagtgttggctgcaccactaactcacctcctataagttagtacagacactcttcattggtcatgtgctacctggcaggcactgagctagacaccactgacaaaatgatggataagaaacttactgggcaggacacagtggctcatgcctgtaatcccagcactttggaaggctgaggcgggtggttcacctgaggtcgggagtttgagaccagcctgatcaacatggagaaaccccgtctctactaaaaatacaaaattagccaggcgtggtggtgcatgcctgtaatcccagctactcgagaggctgaggcaggagaatcgcttgaactccagagatggaggttgcagtgagccaagatcacaccattgtactacagcctgggcaacaagagcgaaaatctgtcacaaaaaaaaaacaaacaaatgaacaaaaagaaacttactggccaggcgcagtggctcactcctgtaataccagcactttgggaggctgacgcaggcggatcacttgaggtcatgagttcaagaccagtctggccaaaatggtaaaacctcgtctctactaaaaatacaaaaattagccaggcatggtggcgtgcgcctgtagtcccagctacttgagaggctgaggcaggagaattgcttgaacccgggaggtggaggttgcagtgagccaagatcatgccactgcactccagcctgggcaacagagcaagaatccatctaaaaaaaaaaaaaaaagccaaacttactaggtctgcccccagtgaacctgcatgctggtaggtatgggaagacagaagaagggtcgggcacagtgtcttaaaaaagttatttgagacaatgccatcagcaatgccatcagcattggacgatgggagaatagatcatctcacttgcccattcttcaaatggccccaccgaaagcataggttttaaactggccattaaacctgctcgtgactttatcaacctcagccacatttatccggatggaggtgtagtctttgatgctgatgatgcagttgctggtggagcatttcatatacgtccacaaactcactagcattattctgcatgttgaggccacacctgttgccaccacacctcatatgagcagataaagcacttaattattttttgtttatttcttggctgccatctcatgtcgtagaacacaagtccaccgagtaccaggagccccgccaggtgttggttatgcagtgagttatcttctgtcttcccatacctaccagcatccgggctcttatatgcttcctctcggcctcccaaaatgttgggattacaggcatgagccactgtgcctggcctcaaataactgttgactggagagcatattgaatgtggaatacttgtcataaataaatagtgaaaacctaaaaacaataattattattactacgttagtgataaatttaaaaagaacaagaggaacaggctttgatcgaacttggcaggcaacttaggtaagaagataaaggatgaagaaggtgacattattgctgagactcagccaagccaattatgcaaagacctgggagaagaacatttcaggaagtacaatagcaagagcaaaggtcctgaggcaggaaagaacttgccatgtttgaggaattgaaaagcagtcagtgtgactggaatgtggaaagtaggagggagaatgggatgagatgagattacagaaaaggtaatgaaggggccaggaaaagcaagcctcctaaatatgatggggagtcagtaaagggtttgagcaggggtttatgttttgttgttgctgttacagggtctcactctgtcgcccaggctgcagtgcagtggtgtgatcatggcttgccgcagcctcgaactcctgggctcaagcgattctcccacctcggcctccctagtagttgggactgcaggtccgtgccaacacacctggcttaatttttaatttttgtccagatgaagtgtcccggattctgctgagagcaaaatacagaacaacagcaacaacaaaatagaaacaaagaggacgagcatggtggctcacacctgtaatctcaggactttgggaggctgaggcaggcggatcacaagatcaagagatggagaccatcctggccaacatcgtgaaaccccgtctccactaaaaatacaaaaattagctgggtgtagtggcgtgcccttgcagtcccagctacttgggaggctgaggcaggagaatcacttgaacccgggaggcagaggttgcagtgagccgagatcgcgccactgcactccagtctggtgagagagtgagactctgtcccaaaaaaaaaaaaaaaaaaaaaaaaaagacagaaagaaaaagagcaagataaaacaaaacaaaaaattaaaaacttttttttttttttttagataaaaggacatggcatctccctgtgttgcccaggctagtctcaaactccaggactcaagtgattaacctgcctcggcctcccaaagtgctgtgctgagattataggtgtgagccacccaccatgcctgacctatttgggttttgagaagatctctttggctggggagggagaatggattgaaggggccaagtgtaaagcaaatagaacaggaattacaggagttcaggtggaagacagtggtttggcctagggtaagagcagtggaggtggaaataaggagcaaattcaagatatacttttatttttttaaattttttttttttgagacggagtctccctctgccacccaggctggagtgcagtggtgcgatctgggctcactgcaagctctgcctcccgggttcaggccattctcctgcctcagcctcccaagtcgctgggactacaggtgcccgccaccacacccggctaatttttgtatttttagtagagacaaggtttcgccgtgttagtcaggatggtctcaatatcctgacttcgtgatccgcccgcctcggcctcccaaagtgctgggattacaggtgtgagccaccacgcccggccgttttttatttttatttttattttttattttttttgagacggagtctcactctgtagcccaggctggagtgcagtggtgtggtctcggctcactgcaacctccgcctcccgggttcaagtgattctcctgcctcagcttcccaagtagctgggactataggcgcgtgccactacacccggctaattttttatttttagtagagatggggtttctccatgttggccaggctggtcttaaactcctgacctcaggtgatccaccggcctcagcctcccaaagtgctgggattacaggcgtgagcccccacacccagcctcaagatatattttaaagacaggctggacatggtgactcatgcctgtaatcccagcactttgggaggccaaggtgggcagatcacttgaggtcaggagttcgagaccagcctggccaacatggtgaaaccctgtctctactaaaaatacaaaaattagccaggcatggcagcacatgcttaaagtcccagctattcgggaggctgaggcgggtgaatcacttgaatccaggaggcagatgttgcagtgagccgagatcacaacactgcactccagcctgagtgacagaccgagaccctgtctcaaaaaaaaaataataaaaataaaaaaagataatactgacagtgcttgctaataggctatacatggaagatgaaaaaaaagaggaatcaggatagcttcatggtttggagttgggcagccaggtggacgaggggccattttacagaccaggggcatggagggagatgcagttgtgatgggggacagcctaggagacttccatctgtgacaatcccagaggaatcattgggtaggaagttgaatatctgcatccagattcattcacacaggcacagggaggagactgggctagggttatggttatgtacatgggagtcatcaacagtatgtaatatttaaagccaagagattcaaaaggatcatctagggagagcgtgcagatggagagcgctaaaagcgcaggaaggagcccctgagaactccttcagcaaaggagactgggagtaagcggagagaggatagtgcatggagaggacaccggatgctggaggacatcatcttcatcattgacgggaccttcgccaataacacatgccacagaaattagtactcacccagataaagggagtaaagaggaaaatgatggtgcaaaactgcgttcatggccgggtgaggcagctcacacccgccgtctcagcactttgggaggctgaggcagaagggtcgcttgagtccaggaccttgagattagtttgggcaacataggaagaccctgtctccttctcttttttttttttttttaattttttgttttgttttatcttgctctttttattttttaaatttttgttctgtgttttgctctctcagcagaaccagggagagcccatcttaacaaaaatttaaaaattaggccgggtgcagtggctcatgcctataatctcagcactttgggaggccgaagcgggtggatcacttgaggtcaggagttcacgaccaggctggtcaacatggtgagacaccgtctctactaaaaatacaaaaatcagccaggtgtggtggcacacacctttaatcccagctactcgggaggctgaggcaggagaatctcttgaacctggaaggcagaggttgcagtgagccaagatcgtaccactgcaatccagcctggaaaacaaagtgagactctgtccccaaaaaaaaaaaaaaaaaaaaaaaaaaaaggccgggcgcagtggctcacacctgtaatcccagcactttgggaggctgaggcaagtggatcaactgaggtcggaagttcaaaaccagcctgaccagcagggcgaaaccctgtctctactaaaaatacaaaattagctgggcatggtggtacatgcctgtaatcctagatactcggaggctgaggcaggagaatcgcttgaacctgggaggcagagtttgcagtgagccgagattgtgctattgcactccagcctgggtaacaagagcgaaactccatctcaaaaaaactaataatagaataaaattccctagaagcagatctgagataaaggtttgtttgtgagtaatttataaaggaaaggctcccaagagaaactggtaaagggagtgtctttcttgctgccttggatggtcttgaactcctggactcaagagatcctcctgcctcccagagtgctagaattacaggcacgcgctgccatgcctgtcctggtaagggaatttctcacagtaagggaaagtagaataggaaaggagaaggagctaaaaggagggtgatgggccgggtgtggtggctcacatctgtgatcccaacacattgagagaccaaggcaagtggatcacttgagcccaggagttcaaggctgcagtgagccatgattgcaccactgcactccagtccgagtgacggagacaccttgtcttaaaaaagaaaaaaagagagatgggtgattttaggtaaggtctcagccttagcctgatctgcatggagttctggagaataaattgtatctccaagtttgttcctactcaaggcaagggagctgggcctcatatcacagcacttgtcagtcaagacaagtaacacagtaagacagtaagctcctagcctctttgtgtttttaggcagagcagttccagtagcctgaggacaattcttcaaagagaatatagatgtaagcctttggaagcaaaagcccagagaatccagggtggtgacccacagaagtggtcatgggacctttcagcatgtggagggtgcacctggagtgtccactaacactccatgtaggcatttaaaatgtttcttaggggtcaggctcggtgactcatgcctgtaatcccagtactttgggaggccgaggctgatggatcacctgaggtcagcagttcaagaccagcctggccaacatggcaaaactctgtctctactaaaaaataaaaataaaaaaaattagccaggcatgctggtggacgtctataatcccagctactcagaaggctgaggcaggagaatcacttaaacccaagaggtggaggttgcagtgagccaagatcacaccatggagggtggagacgtgtgggaagagacagatggaaagaagactactgaaaaggttaaaaaaaaaagtatgggtgggaagtgaggaattaattctgtggcagtggggacagacaggagagccagactggaaaaaaacccagctataccagcttggaaaagttacttagcctctctgggcatcaaattattcacctgtgaaatgggtcaattacaataatagtgaaaaaataataatagtaaggccgagtgcagtggcccatgcctgtaatctcagcactttaaggccaaggtgggtggatcacctgaggtcaggagttcgagaccagcctggccaacgtggcaaaaccccatctctactaaaaatacaaaaattagctgggtgtggtggcatgcacctgtagtcccagctacttgaaaggctgaggccggagaatcgcttgaatcaaggaggttccactgagctgagatcacgccactgtactccagcctgggcaagagagtgagactcagtctcaaaaaatacaaaatattttttaaaaatgataatggtagtgacatttattgagcactttactgtgatccagctacagactgttccaaagactttgcaactgttatttttgcttaatcctcacaacaacctatgaggtaggcacatttattgcccccatgtgaccaagggagactgaggctcagggaggttaataatttgcctaggcacagtggctcatgcctgtaatcccagcgctttgggagacccaggcaggcagatcacttgagcccaggagttcaagaccaagctgggcaacatagcgagaccctgtcgctacaaaaattacaaaacaaattagccgggtgtggtggtgaatgcttgtagtcttagctacttggggggatgaggattgcttgaacccgggaggttgaggctgcagtgagccatgttcaagccactgcactccagcctggatgacagagtgagaccctgtttcaaagtaaagaaataaataaacaacttgcttgagttcccgcaggtagtcctttccccaaaagattgtaggaaacactaaatggcagccataaataataattattggctgggtgcagtggctcacacctataatccttgcactttgggaggccaaggcaggaggatcccttgagccccagagtttgagaccaccataggaattatagtcctaagatccccatctctattgatctggagctattttcactaagctttgaaatttcccatcaacctcaatctccatcaacacacactaatcctgctgactttgttctcattctcgccgcccttgtactcccctcccctccacactccccttccctccatgaatacctgacttctgccactcctcagccccctctaagctctttctcaaaactaccctctaaggccagcaccgtggctcacccctgtaatcccagcactttgggaggccgaggcaggtggatcacttgagatcaggagttcaagaccagcctggccaat

SEQ ID NO: 355 - DNA, 335300 bp, Homo sapiens
cttttgtacaaaacttgtggatccatcaatgaggcatctgccattttttctttcttcccctctatattacaagttctggaatgcctgttctaattctccaaggagaattagaaaataaaaggcagagtctagagccatgtcaatatcctcccacagaatgtgtatggagaatattccactgggaaccatgatagataaaaacttaccaggaagagcaaaacatcaagagagtctgacaaaagctctgccctcctctgtaacccagcagcctctgcagaatcatcctttcttcattgttttaaaatgttgttaaataccttgtcagttgctttaaagggacccagacccattctgatatttttacaaaataaatccagtctttgggtaaaggtatagtaatactatccatggatctgatgttgagtcgtggaggcttcaagctctgaagaagtatgaactaattctaaacagtgattaagcaattattattttcattttactaatgacatgacttctagagttggagtgtcagaatattctcttggaagaaaaggatgcaagtgtagacacctcatcactaggtccaatccacctcacagtgctactttcagttttgtaaaaattggtcacggcaacaagtttgaaataataggttcactctcaaactggcaacaagcacgtgattgagctgcatgaatctggaaaggcttgtcaaacaaaacaggctggttcacagctgaaagaaaaaaaatacttctggcattgtactaaattcagaaaccgtatccgacaaggggctgagctgaggttgtggtatggccccagtcctaggattggtcccacctactttgcctagttcctgaccacatctggtaattcagtggtgatgtgattatgacattaacagtgataggtttcccctgcttagctgcttatttgattgtggataatgtgtgaatgggggcaggagaggcagtggttgggcgctgatgtgttaatgaatcccatgtctcaataattaacacatcttctggatagctttgcaaaaatgcaatctttgcttcagatttcacatttaagagcatctccctttgctttgtgtttaaagtttaaacattcagtccaaattttaaaggtgataagcaaatttagtgtattttgaaggaaggaaaacttttttccttttcacttttctctcaccatgtacagttgtttctgaagaatgtgtctagggattgagtcagaactatcaggctgggcaaagtggctcatgcctgtaataccagcactttgggaagccagggcaggcggatcacctgaggtcaggagttcgagaccaacctggaaagagctcctagaagagtcactggtagaaccaactgctcacagcttctttgggtgctagactcatttaacaaccagttgttggaaaaattttcaatcctttttgataagaaaggttctcataaaaaaaaaaacaactaaatctatgcagaatttgtgagaacaacctgagaatatcaagaatattttaagtctcatacatatatttatcatagacttatctgtctcaaataagatctggagtgtcaaatttctcacaggattaccgatggcagtaaaaaccttgttctccttagagttttggactgaaacttcaaagacaatattttcttctaaatttaacaataacagttgtagttaaaaataactttccattataatatgatgttatcctttgcttagattcaatgctacaaaagttctgttgatgaaatagaaataaaacaaagtctttccaccatttccaagggcaagtgtcctagacgggctccagtatgtaatgcagtggctggttaagtagtttccaataacttggtattgacattactgccccttctgcaatctcactccttactcttgataagagagctctgagaaatctcaggtaccaactgtttgaaagggctagtttgcctgttagcaggatcttggagggaaaatgctagggacaagatgatcagtgtatatgaaaattggaagttagttcagttaagaacatctaagctaaaatacgaacggcagaggacccatgtggtcaaagatgtcccggtatgtgtggtgggactgggtgggcctcctactcctctgctcccagcacaccaaaacacgtgtttagaaaatgccgattcgtgaacccgggaggtggagcttgcagtgagccgagatcccgccactgcactccagcctgggcgacagagcgagactccgtctcaaaaaaaaaaaaaaaaaaaagaaaatgccgattaacaacaggcatgggaacctgcctgctcagtgctatgtttggagggaaaatataaaaatctcatgtttttaattccccagggttcgaccttgaccagcatatttttttccagagcttttttcaacactttcccaaaaggcagagggcaattaaaagtcagaaagaaactctaattggccctaaagattttctgtcagaaatgcctgctaaaaaagaaagaaaaataaatgtattttaaaaaagtacttctctttgtattatagaatatgtttaattaatattattctaagcccttttcaaacagctctgaatttgtatctttagctaaaaaggggggaggtcaggaatatgcttccttccatgcctctccaactctttctcaaaggatatctgatactaggacaatcctagacatacagaaatgcagctgaagtttacagagatcacctacttttacatgtgtgtctctgggctgtatgctgtagcaagagaggggacagaggagatccagtgctgaaacaatgtctgatcctcatataaacagttctctaactatcattataaatattttttaaaaatttttcaccagttggaatggaaacttttagtcaaaagaaagaatattgaaaacaacgctagtatttactgtacattagaaagccagtgtattagaagccttctaactactgatagatcagtctgggccttgtggttcatttgggccagactcaagctcagtatcccatctaatgcatcaaatatttatatatgaaaaattctgaaatgtaaaaatcaacatcaaaatggaatcagcctttcataaatgaaattgctaaactgtgaagttgtaaaatttagaaacttgatggcttaaaggaagaaagggaaattattgaaggtaattttaatgagatacctgtacaggtccaatgtattctacaaataactcaataatttggaaacgtgtgccaaaaacatgcttttctttggttgccaaagccaaaaagtatgtatgcccaactttgattttcatataaaacctgcgaatataaattgtactgttgtttctggaaactgggatttatttcacttaaatataataacttgcaaatatcttagggcaatttgtaataaaatcctagttaacacatttttgtgccaattctcttatttttaaatacgctcttattctcatcccaaatgccatattactcaattacatgagcattatttgaatgtacaatctttcaagatttcttccttggagtatttctcaaacttgagcattaggatgagtacaggaagggagagcaaggtatctacagaaaatattatttttctcaaaactagccatctggtcatatcactgttaggtttaatgtttgtacaatttagttcactctttgttttttaggtggaattacgtcaaaaagtggttacatagttggttacttaattggactgttctttccatttggaaagaatgggaaatacagtcaagtatgtgatcttcacattagagggagggccaaaagttctccttagataattcatctcttgttttactatgtggcttcaaggggtctaattaaaaagttgtgtaaattaaaagaaggttgggaatgtaaggaaatgtctctgaaaatctctgggcaggattcttcttggcgaataagcaatcttagtacggagggttgtataattattctagtaactttatccccccgtcccccagtgcattcttggatttaactaggcgtatctgtctttgcagtcaacaaattaggagggctgggctatatcttaactgtcaaagtagacagattaacagtgaagttagctaatttctctcttggtctgtttggctattaatgtgaacttttctaccatttgcatagcagaaaaatagtacccacagagaagcatttgacccactcatatttcttagaggcatggaagctatctgttacgtttttctatgtttacatactccacctttgtagaaaccctcatgagcatcagggatgtgaatgtcggttctcattcccaatccacacctacatattgatagaataaaaggctaggtcgatgggcagcactgaagcataataaatatgattcaagaggtataaaataaacaacactattatatgtgtaactgtaggtatgatctgtcccgctcatttacaaagattccatactatgtcctagtgactcttatctaggtggaatgtcattatatttgatttctcctatgataagttcactttcagaaaaacatgtcttgagcaatcactttatagcataagctctttccctattgccgggaggtaatagtgagcatcactaagggtagttggatataatgggagtagtcaccgaagaactgcaaaggctgaaattagggaaaggaaatattaagactgtttattcccatggggaaaactctccaactctttgaaaaaatgctagggaagcataattctaaaaaatgtgaaccactgaggcagctatgaatgactacattgataacagatagacaagacaattttgggcaagcaagtcttcctgaaaaaatatgggtcataattttaactactaagtcatattgctttttgaagttatacagtaatgctctttcctaaaagtaaaacaaaataaacaataatttacataaccactgatttaaatgtttcttacaaaattgaatcagagaacctttgacaaaactgaaaatgtggacagcctctgagtacatttggacatcttgacaggcagggaaaaagtcaaagaaagtgaaatacgtaccatttcttgtgggctggaaacctgcagtgctttcctttgggagttccacctctcagtggttgctccttttatagataagacagtctctgctttgagagacgattaatcatggcctaattaagctcccaacatgaaatatctatttcaattgtttacccttcctatgctgtccttgtgggtgtaataccatcgggaccgcccagcattttgaaatgtactgcgtgatgggaagacaacaagatggttagaagtggtgagtacataatggtaaaaaagaatagcagaactacattctattagcaaaactccgtaggtagagctgaacaaaatctaaggaatccacttataatagcatgtttctttttctgaaataggattctgtatcttctgcataatgcactcaccaatttaatgattggaatttatatttaactttgctcagttttaccaactgccttggccaagtgaagtgattacaatgataaaagctgaatgccagttgtaggtcaggtgagatccaatattacatgctgtcaatcataaaatggccaaacgttcttgagattatgaaactacactcagaacttgctctgcatgcaactgcccaaaatcatagtcagaaagtcagaatcaacagagagactccatatccccagcccaaaaatattaaaagaagtcttaaaggggctgatttattctcttgagaaggcaaagttctgccactattagaggatggagggcatcatcatctaccagagaaaattttctaattgcttccacaaagttatcagatgtatatcagtctcgctactttattttgacagtttaggatcagggaccttttgctgtggaatcaccaatgaatcaagacccctgtggaaaatgcaatgtgagtggtgagctttcattaatagtgaggccacaggggaaaggcatgcatcagaatttttgcagggtttctaaaacaatattttgtaaaaattttatgtttgaaaagcaacaaaaaattagtgctattaggctatgaactacaaaaagcaaaattttataaaacactcactggttgaaggatggaatcaggaaatttgaacccattaaaatttgcttgtaagaaactgataattatcaggtcacagaatttttctgaaaggttgttagacggtcaaggagctctggtcattgaattaatctttttgctatataaagaaatagaggttggctgctcattttgtgttaaaccaaaggctggtactcaagagacatattgacagtttgatactataaaatatttaaataattccttcattcatacatgaaagtataccacatatgaccatataaagaatataatgaggaatactaaagaaaattttaaagatgatcggatcaataaagtagcatttacttgtacatgtggacagattctattatagtaagaactaagtccactaatatgtcaacttcaaataagtacacaaaccttagaggtcacattttttccccacaaatgcttattccatttctgacatcacttccttctatactgttttgactatatgatatatgaagttaataagatatagacagaaatcgttaatgcgaggcagaagttctacaagaggaatataacatatgaaactaaaagagaaatttacttaaacatccccttgggaagaaactgtactaccatcaattttgggattggaattttttgggatcgactgatttgatgtaatactctgcatgctaaaaagttgtctgacatgtaactgtttatgggcttatgatcctggatgcaggaaaggatgtagatagagtcatactaagcaacgtaaaaaaaatcagtgaaatggaggaatgtccaacatatatctcagcactgtaggacagacaaatattctgacactgtgttctcctgggacattaaaaagagaacattgcatgaccgaagggttgacgtttgcaagagtttgaatacttggtgtctgtttttttctttggatgatgataccagttgcacaataataccattttggtttttatttcttcaaaacatgaaaacaaaaaatgaagtagatgacaatgagaaaggagaaaacatttcatacagaatatgctgtatcactagtgattaaatcagaaacaattagaaactttatttgtctgtgtcagtaatatgtaccatttataaggaagagcacaattagtgcatttcccgccccccccccaagctgtgcacaatacacacaaaataaaataattttacacaactataataataacaatcctgaacaaccagaatcatagtttcctagaacatgaaaatttaaaaagcaaacaaaccaaaaagctttcaaattgaaatcgaccaatgcaagaatttcttaaagttctctgtgaaaatttgctacaggattattgacattcctaatacagctaaaaaatgagtgcaaaaatttttctaatgtttaaacaacttatattccttgaatatatttacttggtgcttctaggctagctttccatttagcaattctcaaaaaaaaaaaaaataaggatgggaaggatgggttagaatgacaaagaattgtaaagtgtgggccatagaaaagttccattgccaacaaagataaaagatgggatacactgggctttctcagtgatctggatcaccaacatgattgcccttcttggtttaaaatggagagatatatttatctgcaagtcggtcaaagataaagagggtggttttccaaacatatgccttatgctctcttagttaaagaaattcttgggtataaatacaatttggacaattgctttgatacagtttcagtgtgtttatgttaaaagagtttcataattgttttttcttgcaagataaaaatctttccatatggctttcttcacttttactcatgaaaatagtaatcacataaactgtaacccttctgagggcagggatctagactgttttgttcatggcttagtccccagaaagtatcatactacctggcacattaagtgggtaaccagcatttaattactcattcagtcaccaaatgtttattaaatgaggaaggatcatggttactgagtgacagaagaaaaaataagtctcaacagctttaatttattaagtatttttgaatcaatacagagggctaggaatgtctccagcctgggattccttatagacacagaagtctccgagaggtgaccaaagtcattctattatttttctcattagtggactcactactttggaatgttgggtttatccatgttctttggtattttaacatagaaacagctattctttttaaagggttaaaaatatcccagtccaatcctcctgggaggtactagtcttatttaattgccttctctttcagcataagtagaggagacaacacttttaaaggcccgttggtcaccctggcttctttcttactcagcaactactgatataatcaaagaggactagactggacagtgaaagaaacagggctcaaaatagccttttaagtaaaaaaataaaatgaacaaaccagcactatctaccatctgtgccagacagtgcagatgtgaaataaatactttgcagggaggggtgttgtggaaagggtggctctgaaagcctaggcacatccaacatatcaacgtctctataaggcctttctccttggccttcctgaattaatgggtgatttttagaggcctctgatgtgttccacatggctaattttccatgaagatctttgtagtttgcctgctatcctctcaatagctttaacttctccccacatgacagttattgcttcttagaaatgaatgtgcagaaccgtgaacaataatccattttctccttttatccctagtaattaatcaaactcaataacagcacaaaagtaacaactcaggtgaaaagaaaactcacttatgtcttcaatgtccaatcaacattgccaaatgggagaacagtatgtactatactctactatatacagatactctttgttttgttttatttgtttttcaccatgcactgtgtaacaggtatcacaacaacatttccgaacggcacatgaagaaggagcaaatgttcagtcatgactggaacaggattgtgcaagccatggatgcctttgaaaataaaactgacagacaatcccaagcaacggcaacatgggactgagacacatgttaatgcaaatggaaaacgatgatgtgctttttgaatggggttattcttactgtttgcataggggatggcaggtggacaggaggaacagggttgggatggggcacctgggggcttagctgggctgaatgctggaagaaggaccttgccaatcacagtccagagctaaagagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggtaagtgaacatgacaaatgtcagtttcctctgtccattatacataatttttatgtatatatatgtatatatataaatttactatatctgatagttcctttagaagccttttatgtggcagtaggcctccagggaggagaagaaaatgtacaagagccataggagcacaaagaggcaggatgtgaggagcttggcagtccggggcccacccagctcacctccgatttctggcctccgccgatacagcagcacccccacattgatgaaagcaaaaatggtgaagagagtgacagagaaagctagtgtgccaggggacactttgaactgttccccattggctgcgtggtagatggcagcgatggaccaggccacaccgattcccaggaagacattcaccgcgttgctgcccgtgacgttacctatggaggcgtctgcatactggtcctgggtggctgccactttgctggcaaatgtgtctgcagaggaagaagagaaagtcaatgacactcaatcttttagagatgtctttggagtgctgcaagcttcagctgtgtactctaggacccaacccttaatataaacccagtgaccaagaaatggctttgatgttcctctgagtcagactcatggggtgaaaagaacaggatctagatattgggagttaagggttcagtgctggctgtgtaatggactgagcaagtgatcttggtcaagttttgtatccacagatactgcagttctttgtaatattgaccttgcagggcagcattttttcagaaagtagtcacagctcacctacatcagaatcaagtggggtcctttcaaagagtgagtattgcaaggtgccatgcggctgtgctggtcataatgacagcggcccaggaatctattttaacagtatcctaaaagattctaggtcactaaagtttcggaacagctgctggagggtattactaaaagatgctgtatcagcagctctagtttatagatgagaaagttaagatgtcgggagagatttttcaagattcaagagcaagccaatagtggaattgaaaacaattgaactataatagagtagctgacatttgcttagagccttaagaataaaaaagcagattcagctatattactgcattgattgtgatggtacttttttattattattttttattattatactttaagttttagggtacatgtgcacattgtgcaggttagttacatatgtatacatgtgccatgctggtgtgctgcacccactaactcgtcatctagcattaggtatatctcccagtgctatccctcccccaacccccaccccacagcagtccccagagtgtgatgttccccttcctgtgtccatgtgatctcactgttcaattcccacctatgagtgagaatatgcggtgtttggttttttgttcttgcgatagtttactgagaatgatggttatgaggtgagggaacgaggcttagagatgacaagtagtggatgcaatatcacaactaggaaaaaaacatgttagggctacagctcctgcctcatgtcttcaaaacgaatgctttctcatggtgcttttctacctttcactgtgctgtgggcaccaatgatcattttcaaagccctttatttactcataatcctgactgtatctttttgtgatgataggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttggtaaggtgaaatactacatgtaaataaaatgcttttgatgctttttggcacaaagtagtaggagaggctgtttttgttgttttggaaacacaatataaaccgagcaggctagatcggtttaaaagttgaggtaggatctgaaatagcttcctgtattaagcatgtgaacagaacttgcaagatactaaatttcttgtccacattatgcctacttacatcaaagtcctggctgggcacggtagctcatgcctataatcccagtactttgggaggccgagatgggcggatcacttgaggttaggagttcgagaccagtttggccaacatggtgaaaccctgtctatatactaaaaatacaaaaaaaaaaaaaaaaaaaaaaaaaagccaggcgtggtggtacacacctgtaatcccagctacttgggaggctgaagcatgagaattgcttgaacccgggaggtggaggttgcaatgacccgtgaccatgccactgcactccagcctgggcaacagagtgagactccatctcaaaaaaaaaaaaaaaatcaaataaagtcctttcagctaccttgcacagtaggattatagcagatattaataactgtcaaattgaacttatttccaaagccagtaacagcaagcattaaatgactgcaaggtgttgtgttatctgctctggtcctcctgaggtcctgggcatgctctgagcatgtatgtagttgtacgatacctgtactagtctctcccctctgttgttatgctattgccaccatccttcctccgtaaacttccagtggggaagatatgtacagcatgtaaatatagatcagcccatggattctcctgctttacaatggataagaaggctttttaggctactaaaaggctactgcatctgcagtatgacattcttcctgaaagggagttggtcaattctgaaggcctatcatcaattctgccctctgcctgtgatgaaaagcagatctgattattatttcataattaaagaagtagacaaacactgcttattccatgctaggcactatgctacacaggcaacgtgtgtattctcattcacccctctcacaagcattatgggctagatgtcattactcctctttcatgatatgagaaactgtgacgttgtgatattatgcctcttggatagggtcttagcaaatgtgaatttttaaaccaaagtctgatttcagagcccagtctcagtccacaccacattgccccttccaggaagcctgaagtttgtctttcctcttagttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggtgagtaaaagcaaagcgagacaaatcttaatggtttcttgtacttcattattaaaagttaatagaaacagggcagcagcctcaaaaagaaaaaaaaggaagtttttttttttttttttttttttttttttaaggtcaggcagtggaacatggaaagtaaaggaacaaaagtctgaggcaggagaaagcagcttccagctcaggtacagctgagaaacacctgagatgttattctaagctgaaatggctggtagcactggctggtggtgaacagatggccacgttaggtggggcagttgcgggggtggtaattccctctgtatgctacagggacaggtgacctggtgctgttccatagaacacacctgcttacctcccctggcacctgatacattgcacactggacttcctgggtatcccatgtgtactcagaaactctgggctttctagatggcacctttgctgccgcaccagaaggaaaggaagtttaaaatcaaagactcctgggtctggggactcaaagcacccaaaccagtcctttaggctgacatggagggcacacctgggtatgcagtgatttcctctccctcaagccatgtatcagtagcctattaatgtgaatgttgcataaggattcttacttgtaataataataggttcctattttcaaatgtctttctttgaatttcctaagagttaatagccaaagtgactagcttgtcacataagtaaaacatgtttttggctactttgtgtctcataggttttatttacttgggttagacatcaggccttttgtctgtttttattttcaattcaaaagcaatgtaaaaaaaaaaaaaattgcaggaacacacgcaaatccaaaccactaaccttagctccaacagagagaactctgttttccaaatgaagtgcgatggattctccccaaattaccttttattgccgctttgctgctcagcacatagggcaatacatcacataccatatgttaggtgctgccaagccctactttgaacactaagcctgtaacctgcctatggttaaaccaggcaaatgccatatcctaaaataaaatccaagaaataactactgccttgggtttgaaggggatataataatattcagaggttggcccattagataaaaacttttatatatggatcagatttccaatgcgattgacacaaaatatgttgataataacacatgtattttttccttcatctatgtccctggctaggtttttaatagtttttgctattaactcccaccttgaattctaattaattttagatcagtcatacagttttagacttttagtcctggctccttgatacatatgactataaatcaataagaaggaagactgttgaggagacagcatggctggaattaaactacacatcacaaagtcaggacgtaattgttctttgcagacctgcctcaagttcatggtatattaccttgcccaagtcatctggtcaacatgcaaaaataggccaatactctccctttccttcagcaattattctttacctaaatttctcaaactttattgctacttataggctaagccttaaacatctcttctgcaaaaaaaggtcattctcacagtcttgcaggatggatgcagggataatgtattatctggagcaagggtttcgccccagatggttcatcttattcttggctcttagtgttctttggggaccagctgttcagctctccaatgcttcatgcccaggaactgacactggcagtggttttaattggagtccatcctggctatgaaggtctgcttgcttctcccagcaaccagaccttgacgtattcgttcactgacaatgaaagaggcagccaaggtgtacagatcttcatggtgtagtagtggaagaagcctcatcaaagagactctcggctcttccaactgtctgtatgctctcggcaagtcacttcacttttttagattgcagtttcctcatttaattagagtatctctaagactctttctaactttactgtttgggtggtgcacagaatacattaaaatactaaatttatatgcaatgtttgattttgctggtttttttgataggagtttgtacataaccactcttcacaataattaactgatgattataactattttatcattgtgaagaagaaatgacttaaatatttgaaaatcctaggaaaatctcaagacctgaagatactacctttgatcaaactgtgacaatatttatggaattaaactacatggcacagtcatttaccttttaaaattaggtaagaaatgttggcaaaattatcaacttcaaatcactctgactggccattcattgatacgagtgaagccaaggtggcagacagatgaccatgtttcaaaggctgtgtctagtgttaatagtgttagaagtacctggagagctttgcttaaaaaatgtaggtttggggcttcacccccaagcttgtccagcctgccttattttgttgttgttgttctgttttattttgttttaggcttttgacagcctgaagccatggtttttagtttctgtctctagtgataagcagacaggagggatgtcgaaggggctttactggcccagacagaaacagaaactaagaagccatgactgtattctctctcttgggcatccctgctagatccacttaatcagactctctgaggacgggatacagaaatacaccttttaacaagcggcctaggttgttcttatttataccaaggcttgagaaccacagttgtaagacatgggaaggggagatactactcgaagtgcccacagttttgggggccttcctgcgagtaatagatgtttgagtttcagggaagcagctaatcggaaagaagtaagaagctggtttctcttagaaacatggatgcccttagctatagtggttattttgctgataaaatgtgggtaggcgtcacggagatgctgggggctgcttaattgtagcttcttccactcacaatatggttattctcctatttttttaaaccctattccagctaccctaaaaggccaaatgagggggaattacctaaattgattgaattgtgctgctctgtttgccaggttggaagcttacctacttcatagggttttgaaggaaatgagttaacatgaatagaatagggcctggcacttaatgggtgttcagtattattagctatttttataatacaacagagccagatccccagagaatccatacatggtagggaattctgactattgccaatgattctatacttttaaggagttataacaccctttaaaaattattaatttgacaatcctttgcatttaaaagtgtgatagagcttaaaattcttaattattttactttgaaaatttcatacaaccaaagtcattaaaagacattagagctcttttggtttagagcccaaatcttactaatggctgtaaggtagatatctttacttaaacagtgtatatattcctctcttttttcttttttgccttctataccctcatctgtcttgctcttttagaattaaaagagaaatagtgtttacttatgtacttgttcttctgctgtcactgaagaccttaaacaagcatttgtctttggttgcgatatttatttacccaagtaaatagaaaacctctctttctctctcacaagtgcatgcgcgcgcgcacacacacacacacacacgtgtgcgcgcgcacacacacacacacacttcactggttcatgtgaaaagaatcatcatttggcttccaagtgaagttcaagaggtaacagaattgctgatgtttgactgattaataaccaggtagatgaggagttgaaaaaaggaaacacactgaaaatttctgcccataaaagttgtccctgaagagggtaaagaagaaatggagacagtgacatgacctacttttagaagagaaggaagcagcgataagtaaaaagttcaagaggacctatattggcaggatcagggcacctgcttctagtcacttttgtccccagctacaaatgagagtcagcaggacaacttttgaaaacatgaacttgctagccccaccttgagtttctgcttaatcggcctgagatgtggctggagcattggtatttatcaaagcttccccaagcagattgagctccactaactgaccactcacagccctggtttctttgtccctgtaaggaggacaatgatgcctcccttagattaactgaggtaatgatgtatggaatgagtgacacatagatttgtttttagagtaaccatttttgttattgaaaaattagctatttttcatttttgcatgttaacttgaatgtttgcactttatggaggtgccccgggcttagttttcctactttgtatctgatatcctgctgtattttaagttcaaagaaagaaatttattctaattaaaggagagaaaaaaatggaggtttatttttcagggaacacaaaacagtgaagtgaaaggatacaaaccagcagcgcagcactatttgatctgctttccaaactgtaattggagtcatgttctcaaaaggaaatgataagactccactacacacacctagaataggattatttttcagtgtgatgttcacaggtgtccaagagagaatccaaggggtgctgacaaggtctagataactgatacatttgacaacggacagagtgtccaaggaaaatatcaagaagcttcatcatgttcaactccgactgtgactacacaatggtaaagcagctgatcgtttgaaagaaaataaatacaattattccatatagaaacatcaggctgactcctttagcaaacatggataagaaacagattaagaaggagctattttcatgaaagactccttattctttaataccattaatggagataattctctgataaggaaaattacactctgccactcacatacacacactcacttcactggttcatgtaaaaagaatcctcatttggcttccaaatgatgaacaatttttttttgattccttaaattcttggcttctcctggcattacatttgggctgtctttatagtactttaaaatgggctggaatgaacttgcttttaaaatagcatcaagtttttgatattttcagttttaagccatgattctgttactttcataataactcttattttaataatgcaaagtccgtgagggcaaaaagaatcataagatttagttaagcaacatttggctaattttgaaaaggaaaaaagcaagggcaaatttgaagctaaaaacaaatagctgaattaattgtcattttcccaagccagatggtttgttattatatagatataactgaaactaacttcctgcttaaacacaatctagggctgccctgcacagatcggtgtcctctgactcgcttctcctcccttcccaataatctccctctttcagttaatcctctttgcatttgaagcctagttctttcttctatgctttgttctatttctggaacatccatctcctatccaaatctcctcaaattctcttctctcctattttagagatagtaaagacataggttcgcctgtcttgctagagctagctgagaaggatcagatagagaaactgtactctaacttgaagagaaataaaaagaaaacagaaaccttcattctcacctgcaggtagccttaatgggttataaggaaacttcgttgtcagctggattatactggtgtgattctaagtgtatggatctagacaatacaccgaagatgcccaaaatgtgcctttccccaatggatatctacctagttagttactcactccagagacacttttttgaaggggctgctttgtgtattatcagttcacaaaaatatgaacactattaaaagtaggccactgcatgcaacctcaatccagcacaggaggcagcaggtgacacttgaggacacgtgagacttgaatgggttctgaaagtttccaataattcacctattttgccttccaccttgctgtgatttggtgtaaaatttcctccattaactcattcctacagattagtcataggatacaaaaaagcatatgtgcctatcaaaagcctgaaaagtctactaactatttggcccagcaattctctacttctgaggctctagaggcaattttacaaacacacaaatttatatcagggattggagcagagtttctatgttagagaaaaattagaaacaattgtctatcattttagaaaaaataaattgcaacttcatataacatgatactgtgcaactgttaaagtacactaagaaaaacattcatgacacactgctttgtgagaaagcaggttatgtaactatgcctactattagtccataaaaaagtatgggtaaatatttgctatatatctgtatacacattttttgtgcaatttacttaaatgtcccaggatttcacaattttaaaggtgcaaatggctgaatgtagatggtggtgagatggcaggatttctttttgttgcttgcttattaacattttctatttacaaagagcatgtattgtttattgcttgtgctactaaaaactaataaatataggttaaaaatagacatttaaatagagtctctctgggaaggagtgaacggctgaatttcagctttttcctggtccttttggttaattcagcattcataattatgttagacaaatccttggatgaaaagcatcctatatactacacacagagcaggtgcatctcgaagggtgtagcggggaggaggaaggagtggaatagaagaagaggagatagccttgacatcaggatctggcctgggatccagtgtcccgagggtgcctaggacagtccacaatatggaacaagaatcgtaaaaagcaacttcacccactatgaaagtttgcccaggaccagctgtgaagggaagatgtgtttgtgtcttcattttcccccacctactcgtgttaagcattgaagaactgcagagcagcaccaaaatcttctctcttaattttatattttgtgctacaaataccttctattttatttactaacagtatgttttagtgacttcaacccacaaaattgctttgcatattcacttaacctgacaaatactttttacaggcttgttaagagattcatgtccttgagatgtttgggaagggattgtaatgcccatctttcttgggctcttactagatacgtaacttataatgaaaaaaagaaaagaaaagaaaaaaaggcatagagctctacctaagctgctaagaatatgccatgagcctgatctctcaaaatgttctcctttttctctctcccagggacgtaggacagtttcttgtggatacttaacaaacagcttttgttaaatatctcttatttttatagattcttgtaattttcagagcacgtccatgaatgttatactatctgctgtgcctgacaattctgaggaggaagatgggtgggagcagttacccttagtttcattttgtcagggtgaggaaacggaagctccttaggggtcagatgaatgtgagggcacgaggtgggattagaatccacatcctgtaatttctggtgttcaggtcctcatgctgccagtacatttccaggatccttcatcagtttgccagataacaactccatgctctgaacatgataacacatctacgctgactaactctcagggctgctgtgggtatcaaagagatgaattataaaaacatacttttaaaatgatgaagctatataaatgtagttactatgaaagcattttttatgtgtgtgtgttaaatgcaaggggtctatcttcctgaaaccatcattaaccactgggatcttactgtgatcatttgttggatattccaaagtcctaactaatccagaatatttagaatggagggtctgtgggagaagaatccagggcagtgggataccatctgctgagaacagaggtggtaggggagctcatatgagagtatcaagtgctggagtgagaaggaaaaataattcaaagccattatttgaagtggaaagaaaataacttttcagtttctgggactagacctgcctgagtaaatctaggggtggggtgggggaggacacagattagaggtttgaagtgtgatttgttagagattagtagtgtacaaagtcaaagtttcctattaaaataccccctcccccacataaacactctccattctatggctccatgatctcgtttaattttcttctcagcagtgttcatcctctgtgctacctgaaagtttatcatctgtttataagtaccagtcttactccacgggagtagacatatcatctgtcttgtttatcccccacctccgccatgcccaacactggccagtacatagtgggggctccttaagtatctgagaatgaacgaaaagaaatgcagaatggcttgaaagcctatgctttgccactgggtcatattgcttcctttgttttaattttttaaatggtatttatctcttttttaatgactttatgaatggtgtggaggaaaaaccacttgaaaatttgaggatcaagaatgccacattgcttcagagactcagtttgggcttcctagttagctattggcattgtcaaaatacagtgtttcattgtgaatatttcttgtcattagtattccactgtagactcagttcagttatagaagctatagatgagagagcttaatctttactctcaggataagaatacttgacatagcagaaagttattgtcaggttcttctatgtggtttaccccatttctccccaaagcacagactaaacggcaggaagcacgtccaaccacttccagcgcagcctcaaaccaagtgctggttccccttgagcaaccagaactgcagtcttctaatgtgataactgggttagttttggggttctgatttgccatatttcacccatctgaaggctcatcatacacagaatccttcacagaaggacattttcatgatcacttggcatagttgtggttacctgcttttttgcgactataactcaggaatcacaggctatgattaatcctctggtgggcctatctgtggaccccagtgggggtcattttagtctggagctacagcaagcctttcttgttatcttgacccaggattttttacaatgatgacctaataatagcttataatttatggaggactatgccaaaaagtcccctgggctccagagaggcaggatggggtggggagcaatcgagggagagaaaacaaatacaacacataatttcttgaatgtaactaatacaaccaaaataagctgttttctccttgagtacaaaatacaggatttatagatgctgagctgaacaaaggttataaaatacgggcactaacggagttagtgtttttagatcatgtgctagaaaagatgggtgaacaatgcaaagcatctgatggattgaaatccttttctggaatgaatcagagtataaacaagtaatacacagcttatgtttcattcctgagaaaaggcaggatgtgaggtctgtgtgccgaggagcagtgatgggattccagctggcgctgtgcataaatgccaagcaccatgatttcatatctataatatgcactaccccaaacagatattaaaattttttatggccacatgtaagctttgccttttaaattgagttagcattttatttgttctcttttctaaaaataccagtgggcttaaattcatttgtttctcatgcagggaccagacatggcaatgaagttttgctttcttatagcccctattttcttctcttgcatttagcaacaatgtgtcattctttgtgcagggagatcatgcacagagcctcttaccaataggccttggtctctgtactctcttcctaatggttgtaatggatttgaattgatttaggagccagcagtcagcacctacagtatgacgtgctggggccatgaatgagagtaagaagctccatttgtgagagttgcctccttagcactgtgttgtgatcaactgactgaactggtcaccgacatttggcatttgtctatcattaaacatcaggtactgccctaagagtcacagtgctaattctaagcgccattgtgtgatccccacccccagcaatttgcagtgtatgaaccaagattactgttgggggcagggtagtggaattgttttaaaaaggtggacaaatccatatatacacaaaacaatgaagaacaaaaaatatctcatgtaatttacaaatatatagagagagattctgtgatgaataaaacaaaataatttcaaaatcttacagaatccatggtaaattctgacactatcatgtagagaatccatgacatttttatattagaattagtccttgtgaaaaatagagaaaagtcaaacctattgagtcagaaagtacatcagtggttgcctggggcagagggtggagatgaggattatctgtaaatggccgtgaggcatcttactggggtgatgaaatgttctaaaactggattagggtaatggtagcaagactcagtgaatttactaaaaatcatgaaattgtatgtactacaaatggatgcattttatggtatgtaagtgataccaccataaagctgttaaaagatgcagactgagacagcattaaaataaaaacaacccaccagaaaacagtggtccttgagatgtttcatttttttttttttttgagacagtgtcacactctgtcactgaggctgagtgtgatggcatgatcatggctcactgcagccttggcctcctgggctcaagtgatcctcccatctcagcctcctgagtagctgggacaacaggtgcataccaccatgcccagctaatttaaaactttttttttttgtagacacagggtctctctatgttgcccaggctcatctcgaactcctggactaaagcgatcctcctgccttggcctcccaaagtgtggggattacagacgtgagccagcacacctggccaccttcatttcaaatgtgaaaagggagaaataaaagtcatcaactcaacattatttacaaatcattccttagagactgacactcttgtgaatgcttctgctacactcgatgctcattccctttgcaatacaccctgagcctcaaaagaaagggaaatttacactcattcacataacacatgcataacaccaaccctccaaacacaaaacacatgaacgcacacctgtacagcatgatgtttctaccaagtgcccttgctctggccaacctagagtatgtaagaaggcctagatagaatagaataaaatatttttagctctcttctcttacactgtgacttttatgggactgagtaaagttggctggtatggggttggggcactaatccaaaggctctgcaggacttcagattgggcaggacacatgctgagcatccctgctccctggaccacctcctggtaaatgacatcattgttatcatcctgattcccctccagctttgtactcaatgccaggtgcccatgcagtactgccctttgagagaaataaggagtatgactaccaacaaaaaacccttaaaagtatttaataaaaaaactcttcctttgaggagaaagaataaaagatgcaaagagctttgaaatggatctttcccaggtttttacagaatctttgggtcggctgcatgcggcctattccccactgtttcttagtatacgataacaggcagttatggtgccatttatagagaaaatcttgtaaattctggttgctagccttcttttgtttcattctctcctcaaaaatgtttgcctttgcaggcttcctttaactctaatgacatcatctattcatgggaaagtgtgctggaaagtacaaagcatttaaactccagactgctgcttgctaaagtgaggttaagataaggtcctgtggaaagccatttgagtgattagggctgtcccgtgctgcccgtctggcagtgtccctggttagctttgcctcttggcctgactgcagatctgagggtccattcagcagtactgaacttttttggtagtaaagaaacgtgttgcttattagagtatgtgaaaacaaaatatacttgccctttagtagcctcttggggaaactgacaccatagccactgggaaatactggcttagggtaaagtcactctgttttcttttccatttaagctgatgtgaaatgtagccatccaattaaatatgtatgcacactgtcacaatggcacctcttgacactggctatctgacttgaaatgtcaatgttgagaggagaaagctcatggtcagtgaaactgcaggaaacagaagcacatttggatatgtccacctcactagaattcctaccatagggaaaaatgaagataggctgaaaatttacttagtttttcagttttcaattgctgcaatgtagctaaggtaaataacccaggaggcctaacttgtttatcagtgcattgaaatagaaagtaagggagatccaacatttttaagggtctactatatgcgaggctctgtgttgggtactttataaattctctctcatgtaatcctcactacaactctgtgagatggattttcatgttcctattattctggcttagaggagttaagcaatttgcctctggggatgtcatacatctagtaagtagcggagggagggttgggtttgaacacaggtctacctgcctctctaaagctcatgttcttttataacccctcagcacgtagtcattgtgctaagactttgcataacttctctgagacagaggctgttaactgtcaatctatctgtgagctttgcactgagaacaacacatctatttgaagtaggatgggatgagaagaaatgatggaattaatctgattccctgctgtccttcaagggagctcagaattcagaatgactgggtacagtttcccaaggggaacatgtttgtgatgagtgggcatttttgtgttcgctcctgaccacctctctgctgttaagagtagactgagtgtgtttactggttggtgagaccttggaatattaacctctatggttcccactcctacttctgctcagagatctagaacactggaatgtaatttccaaagctgccagtaagcctgggcagaacatgactgctaggagggtgtcctcaacatgcccttcctgggccccactgaccggcacctgggtagctgtgtatcacagctgtgtttggtctagctcgggaagaccaaatctctctttgtgttcagattcattagtggcacatggctgtgctgatgaggattatcttggtattctattttttttttttttttttttttttttgccagctgggtcagaactgaacatctttcagttgtcttagtgattaaatttttacatacaggaaatgctaatagtttacaggtatagaactggatcttgattcatttctgaatttttttgaaagcatggactccattaggtgtttttcatgccaaacagaataatagttcctgaccttgaagagtttaaatgtaatcttactgttgcatgccttaaaagtaaaaaataataaaattgaggtaaagagagaaatttaaaaatttcttaaaacgtttgtgaggcatatggaaaagagcatatgcaatactttaaaaataagtccaagatggcacgatagagtagctaagtaccagattataaaaacgagagataacatggattccacagtttaccatccctacaaactttggctaaatatggacaagtcatttattctctatgagttttagtttcttcatgtaacatgaggatacttgtattcactctcctataagctattaagtgattttagacagggccactggagttacatccaggcatattgtaccctatacagctccaggagggtcactcagattatggggcctcttggagtatgtagcatacaacctgcacaaccatacaagttacttgatggtccaccgagaagtaaagcgacaggacccagtaaattgtaaagtacttgctgtttaagtattctacagaatatcttagttttgagagttattagaagccagaaaattaaaaactgaaaaacataagctatcaatagctaactgtttttctcagttactaaaaataatataatgttttgtagcacagtgctgaacaaacagaaaaaaatatcattttcaggggaaggatctaagcgtcaaaaaaaataaaggttgaaaggaggcaaaatcagttcacatcacttaatgacataacctaagtaagataatagataaagtatatacagtgcttatgcctagatatagtggagctttgtggtaaattttaaaaatgttccttctctgctcaaaacttttcccatttattctcattttctggtgttttctattccttttgacatttttttagagttgatctcagtgtaaataatgataatagtttcctgtattttataccaattttcagttgatacattctctgagatccatgctgttacttaatcttcttgaaaagtttgtttgaattgccatgtatcattaggctgattttacaggcccagagagtcaagaaattggttaaagccatgcagtaagtaagggttagaagtccaggttcctgaattcagctctaaagctcttgtccctctaccctcttggtgcacagtcgttaacaccacgctaagagaacatggtgaacaaccagggtaaccagttttatatatcaagttctttctatggaattcagaagtcgaaaagtgttgcaatttaaaaatgacataaattttccccaacataaggttttattttattaaaaaggttctatatacaaaattggggggggggggggtggaaaccaaaaccatctatttccttctccttcagccttaaaatccttagagggaaataattcatgtttgacagaatccaagggataaaagaatattcgaaacataggaaggacacagaaaatcatacaatgccagaaactaaaggacagcctatcatacccaatttttaagcttttctggcccagtagcaaccagctggtagcaggaactagtgggagaagtcagcaagcatcaggcacaacccccaccaagacgcgcagagaaagatgaaggcaagacttaatggggcaaaaatcccccccccccaccgactcatcagtatctcagagttctccctgcagttaaaggaggatgcttacttctatttatttgaatccaataggaacaagacatgaaaggaaagtccatattttgaatctgggatataagctggaatgtcctggcccaatatacccaaggcttatccaagtaaataactgtaagctaaaagaatgtccaatgactaggtggcccttagtccaaaaaaaggctgggctccaaatgctccttcttaattttttccctttattttgaacctgtttttccatagaaataatgtgatacataacatagtgatacacttgtgttaggctactgcaaaattcagcactccagagtatacctaaagtttttgtttgtttgtttgtttgtgttttttttttttgagatggaatcttgctctgttgcccaggctggagtgcagtggtgcaatctcggctcactgcaacctccgcctcccgggttcaagccattctcctgtctcagcctcccgaacagctgggattacaggtgcccaccaccacgcccagctaatttttgtatttttagtagagacagggtttcagcatgttggccaggttggtcttgaactcctgacctcaagtgatctgcctgcctcagcctcccaaagtgctgggattacaggtgtgagctaccgcacctggtctacctaaagttttaaaagtactggcctgaggtctgggtcttgcgagaagggatcatagaagagaaaagaatgaagaaaataccaaaaaaataccttgctcctcatcacagttcccaccatagccaaaattatgaaagaggaaaaatgtttgttctgaggtcctcagtgcttttaacttttgtcccttcttactacaataaccgtctcagatatgtcctattcaagaataagcaacactaaaaatcatctacttacctccctcaataatttcaattcttaactgtcgctagaagttattaggaagaaagcaatctgattgaaccaacttgtactaatgtgtaaatgactgatttgtacatgtatttacatatacaacccaaagacaaacacacagatacacaattgcattacttctgtgttagctaggcaccattctaggcactagattagtggacagagttagaaaataataacattcaaaaataagtaaactaaaaaaatccagaatgtaataaatatagaaaatagagtgaaataatacataagaactggttgactacttcacagttggtgattatgaaaggactctttaaagatatcatttaagatgagatgtaattgaagacaaacagccagtcttgtgtaaatgaaggggatatgagacagctagtgcaatccaaagaaaggaatgagcttggtgtgtggatagaaaaaaaggcccatgggcccaaagaacagcaggcaaggaagagaacagactggaaagataggcaggggccaaatcacattggtcttggtaagacagagtgatgcttttcagagtttatcctaagttaaataagaagttactggaagactataagctgtagtctggcctgatttaccgcttaagatgatctctagcagaagcagggagacagataggaggctactgcagagatatgggtgagagaggacagctgtgtagactaggatggtggtggtggagagatagctagatgggctcaaacaagacacactttataggaaaggtcagccaggtgcagtggctcactcctataattccagcactttgggggcggcaggggaggggtggcagggggatcacctaaggtcaagagcttgagaccagcctgaccaatacggtgaaatcctctctctactaaaaatacaaaaattagctaggcatggtggtatgtgcctgtagtcccagctactcgggaggctgaggcaggagacttgcttgaacccgagaggcggaggttgcagtgagccaagatcgtgccactgcactccagcctgggcgacagagcgagtctccatcttaaaaaaacataaatacaattaaaaaataaagatctgtaggacctttgaccatggggaggagaaaaaggaatcaaggatacctggacggaatatgacttgttctcctgagaaaggcaagatgtggaaagagtaggtttggttaaaggataaggccattgggcagtagaaatcaacagttctgttttagatacagtaattctgagctgcaaattacatgtctggcatcaatatagggaagacagctagtacataaatctttcacttagaggaaaattgaggctggggatatacatttagcagtcattggcatatagatgtcatttacaccatggagactgatgtccaggaagtaagcatggaccaagatgagaagaaggatggagaccagtcttgggcttactccaacatttaaaggtgggaagaggctacttgggaagcctctttctccagagaagtaagtctgaaaaatggtgatttgggaagaggaggccctttctctattcacaggcacgggtcttcaagctcttgccaaaacacctaacattgagggtaagtgaagacctttatgaatccttctctgccagtagagtatgagcatttgctaccagctggtgcaaggaagaagctttgtctcacttgaaaatgtataagcttttccccatacattttgaatagtatggtaaaaacacttttgatgagatatatagatattaattccttccttgaggcaggaggactaacgggaaagttttcaatgtccgtctggcctttagaatctaagaatcccaaagtctaacctagaaagaagcagcagaatatcagacactaggaaagagcccttctgtttcaggaaaagtgccaaaacatgggcctagagaaaacgctgggccccaggactgctgctgactaaatagtaggctataaatgaagggaattatttttctttattcttctgcctgtagcaactgggctttgtcacctagaaacaatagcatcatttttcttaggagtcaggatatataataaaacattgctctgaatcagcagggtcaaaaaataaagtcagaaatgtgatgttcatccaacagcctgttcaattttcagtttttggaaaaaatgtctttatatagatatgattgtctgagattacctctgaatatattgtttggggagcttgctgcacagttaatattgcagcaaattatggaattctctcaataacagcacaaagaaatctgcgtcccgatggaaagcatttatggcagtgtagggaaactgtttcaacaacaaatgattctgttgtattttccccaaacagattttcttacctcttgatgtctccacctggcttctgagttagttttaagtggcagaacaagtgactcctctaaacatgaaggtttgctgtaatccataattcatattatagggaaaaattttaattataaggctgccacaattttcaagagtttcttaaaacaagagacacacagaggccttttggaagactgacatttagaaaaagccagcttgagggtatattggataagaggtattggggagtaaaaacactttcaggaacaaggatttcagataggaaaagcattttttaaatccttttgaaaacaagagatgtatttggttggataaactgctgattttggacaattgttataagagacctaatttttgcctttatgatcattatttgcacatattctcctcagagactaaacccatgaccaacagcgtgtgctaacttggacacaatgtgattcagtgacttaaaccataggaaaagtggactccaacatattttcctataattacctcagatagaagcaacggacaaccacaatgttgattcctttggttttatatatagtctctaatcaaaacaccttaagaatattttaagtttttccttctgcttggtaaatttctggtaactctggaaaaagatgcaaagaaaaggaccaatatggaactgctggaacgtagttgggattgagagggagtctgctcttctgtaaggatcgatggtcaactgaacgacttcaaacagccctgcttgctaaggtgaaagtaagagaaccctctaggtctcctagctcctccattcccttaattggttaccagaagcatgtggagtctttaatcagaacccccaggcaggcagtcagttgcataacaccatgccttatggctgaccagtataaatctggatacttcatccatggttaatgaatgaagtgtccagatttatactgttcagatcatcctaacttattcaatataaaaatcaccagaaatacaattttattaaattttttctatgtcccaggtgctttactagatgcataatttgcaggtatttttttccaatcttgaccataattctgcatgttaagtatgattatccctattttttaaatgaagaaactgaggctcagagaggtgaagtaacttggccacagtcactggacgataaatagcttcctgaagaagaataactggtgaatttgagtagaaagaaatacatgatttaaactgtagttgttttcagactcaaaccaaaagtcaggcttgacaactatggcaaactttagtagaaaacaaagtgactatctcaggactgtgggaaatatggaaagtggacagtgaatagcaccattagcacagctgtatttgcttctagtcctgccttttcccaagtctactgtaatgcttgtccttggcttggtatttggttaagaacgtgggtattgttgctcaaagtaaaggctatatatctgtcaagatgctaattagtgctggagactagatccagagtttcagttacaataagctctggtgtgtaccagagtcacttgtgagctttacaacccacattcctgggccctgtcactcctagatcttccagaggttgttgatggttcttagggatttgtatttcttaacaagctctcaggtaattctgatccccaccaaagtttgaaaattattgctatcaatgttgtttgggaagatgatgtcttactcagaaatatgagtaaacataataaagtatagttgcaggtcagacaaaaaattcagcttgtaaggaatgcatgaagggatgttcatgaaatatacatttggcctgtccacttttgtcaggattacttttttcctgtcttgatcaatgcctactttctcttttgtctcattaatatttgggtcaagagaatattttatcaggtctccagtaagtacgttttcctagttacctaaatgaatacagtttcatagagatcattaaaatgtaccaagtatataaaagacagaaatttggttcttaaagctgactctatatttttgttttgtcttttcaaaagtgctcattgcaatgggaagctgatctgaaaatctatccatcaaaccaatctggtctcttacaggccgtggagaccctctggggatctgggatgctttcctgtcattgcaatgacactgaccggcttttgaaccttgagaagggccatgacaatgttccggcagtaacatttatttatacctcagggctctcgtctttcataggtcttggtttgttatcacagcccttgaaattgtaggaaagaaagtgtcaagaaggcaaatgaacttctgctactgggggaattatacatgaatgtaatttgtacctggcactgatgttccaagtgcgacgaacacgactgcagtcacagaatctttcaggccaatggtgcagccaaagtgggaagccaggtctccaatgaaagctgtcagtaggccaatcatgaggatggagacaatgaaacacgcccagccattccagtattcagtaggggggacgaaggcaaacaggaccttccagaacacagtcagaaagtgcatcacgtaatcgaaacaggagggcagcttctcttccccacattcatcgtcgtcatcatcttcccctagagagaatggaaggaagcacatttcatcacaacctgtgttgccgggtcttcctctctctcaatctctcctatctaggtcggtcatccctccactctgtgacaggaggccatgagaggtgggtgaagtttagggttttccaagagttaatcataactaatgaattagttatcaagacactgaaatgcctcttacctgtggctcattggtcaatggcaaaaacttaacccctacccagttctgcatccatgcaatcaacacaccctttctactttcacatctggtaagacttgtcacttcagagaaatgaaaatgatttattccaaaaggctggcaagccctgtgtcagcctgagaaataaccctcttttgaagaaagaaaactatagatggagttctactagggttcttttcttgcaacttgaagtccaactctgggttatataatcacctacaggataatgttcacacagggccgttaatcatggctctgagccttgcatatttctccagcgtcatctcctgcaactatttcaaactcaagccttggaattacttgccaaataattatatgccaaaaaatgaaatttatttgcatttttccaaaccagatacactttctcctacttttgttctttagaactaaatgtgcttggcatatcctaatcgctccacccttatccttcctcacccatcctttaagactcgcttcctctgtgatgcactctctgacctccccccaaacccatgctgggaactccttctcagaggagcttcccaacacttgtaactctggatcagtggttctcacaatgtgcttcctgagcaggtggcacagagaacttattagaaattcaaatgatcagtcccactgaatcagaaattggggagggggtggacagcaagctgggcttgaacaagccctccatgtaatactgatgcatggtcaagtttgagaaccgcttttctaaattgtacatgttcatgttctcttctccagttgactgagaacccttccagggcaggaattcatgcatctttgtgtccctgctgtttgataccatctccagcatgtgaacaaaggtggttaagtatgtattaaatgaaggagtgcatgcagaaatttctattgactttatataactatgcaattacctgatatatatatatcacaattttgccaattaagtcatattatcagtgtacaaagaaatgcacaaagcatgctatttaaaggaaccaggaaatcaataatagtaatctaaaatggagatttcacttatgtgaaaataatgcccattgacatgttttaaaatgaggatattgaatgtcaacttttcttgaagtggtggcaaatacatgtgttatgtggccattttggaaagaagaacatctccttgaagtctttgttgacccattccaaccttgtcatcagggtgctactttacttggtcccactagtgcagccggcagtaggtggggctgcaattttccacctgaaccacgtgacctgagatggccagcatggagcacacatgtatggtcttcgtgagacactctgtggtaggcaagccattgggtgcagatgatgattgagaagaccctctgaaagcacaagagatttgagggaaaaacccctctcagaaaacatctaaagaggaatgtctggatttgtcctctgtcattttacaggaaaagagaagaggcaatggcctgctctttcatgagcacatggttggaattatatgaatacactttgggcgtctgtgaagaaagcagcctcatctttgaggctttggataaactgctgggagaagccattgcagatgagtggaatagcctttggagaactccccagtgaggagcttgagtcaggtcagctcatcagaatgtttgtgagtgaaaaagcattgctgaccgtttgctctgctgttcatgcagtatttattatatcaactttacctggaagcagaagatactttttaataaaaacacctggtatgggctgcactgtgtctccccaaaattcatatgataaagctctgtcatcacctcagagtgtgaccttatttggaaatagggcctttaaaaatgtaattaagtgaaaacagagccattagggtgagttctaacccaatatgactggtgtccttataataggaaattgggatgcacagggagataccagggatgtgcgtgcacagaggaaagaccatgtgagtgtccagtgagaagacagacatttacaagccaaggagattggcctcaggagaaatcgaacctgccaacaccttgatctcagattttcagttcccagaactgccagaaaagaaatttctgttattcaaaccacccagtctgtggtatttattacagcagccctagcaaactacagcagcccttcagaagcctctctatatcatgacgtggaaatgtaggaacaattactcagtgtttctattacctactcttttttgtttgtttccttatacatttcttcttttttctttcttttactttccttaccacttctcttttaccctacactttagctccaggtagaactccatgttagagatgcaattctcagggtttatttgaaggaggaaggaagaagaaagtcacattaatacattcccattcccaggctctcctcttacccactccccattccagccggggctgagaagggtgcatatactcagaaaagttgagaaaaagcactaggttttctagttatatttattttggatcctatcctttttaatttctatatttgtgaacattttataatttcacagggcatatgaataaaatgctttggaaagcattttaatcaatcattcacagaaacatgaactatgctgccttttctctacaaaattacttaatttggggcatctaaatctcttattttgaagacgaacaagagaacaaataatgaagcttctcagaagaaatgccatttataaattgagagtagacattatatttgtcttcaagatggaaataacacctttcccgtgagagatgtacacaggaataattagatcatgtttgtaaagtgtctgagaatatttcaaggtaatgattatcatggtagttatcattatttccctccatttaagattgttactgtgtttctccatcattatttgtttagtcaacatgctaggtcctaaggttacattataggtttttaaaaacaaaaattaattttgccctctgaaattaccttcatgatcaattaatgcaaaatgtgtgtgtgagtgtgtgtgtgtgtgtgtgtgagagcgagagagagagagagaacgtgtgttctttctgtaggcttccaatatcacaaagaatcttaaatgttttaatgcataagtctggaatgggaggcccatctgcttttataacatttgaaaggaaagtggcctcccatccttttctctgggatctcactgctctttataaattttaatctccaactcagacatcacttaaatattaaaaatgaccacggactgccatgcatgatgcacaattaccctgtcttgggaaaggacaaagaaatatcatgttcatccatcaccatctggactacacttaaaagtctgttctttctttgtgaagagtagtgaaacattaaaaaatcctaggagcatcttttatgtgacagcaaaaatgatggtaggatgcctgttctgtggttctgtatgttcaccagcctagggttcctggaggctacataattctttcaagtcccttctctgtgttagaaaagaaagacaggttggtgggtttgcttttatagaatcccaagtaaattcctcttatctcagaatcattcttttcagctaatggaaaataacctgtatttgattaacccttcctattgccttttaaatggcttccctgatacacactggacttcttaaatataactacaaaagtaaccaaatcattaaaaatgcagatagtgcacagggtgtcagttcagctattgatgtaacagtacttggaccgttcctgctcggaaacatgagagcaagagcatcatcagcatgactgacggtgaaagacaaccccctgggctttgcatatatctttcttttaaagtaaacaggtgtttctttacgtgtctctctacctgctcagggcttgaattcagggagagctctgataaccagaaaaagagactgctggaaggtaatggacacgtgggtcagaagacttaagccactttatagttctgacagcttgttttggggcaagacacttaaatttcccaagcctcagttgctcacctgtcaaatgagtttcctaactcccatctctcagagctgttgtggggattggaagaagaaatgctcaagtcctttataaaactatatgcatctttatagacaaatgtgccatattccattattgttacttgtctgaaggaaggcagtatatcaatacaatgtgagtatcctgatttcactgagtatatattctgtttgaatgagccattatcattcatttccccaagctgcttgcttttaagaaaagaaagaaacaggaagggaacctggtggggtgtctcttaaatgacaggcactaagctaaattctttcacatacctgatcttatttcatccttaaaataacactgcaaagtgggcattattaatcccattatacatatgaagatcctgaagttcagagaatttaagtgacttgctaaaataatctcacacagaatttaagtgactgagttgggatttgatctaacagtccagggaacattttactatagaaaatgccttatggaagaaagtagaggagttcagtatcacatattgattcgaagtttgagtcggaatttttttaatgcctagtgttatatagatacagtggtacctttttttttttaggaatgtgaaaatattgaggtgccataattaatatttgtattctaatactttctagatacgatttttgggttgtttatttctttggcagagccagccataagctctttctcagacccgtggggaccaagaaaacatgggaaataaaacaatcaggtaaaagcaggggatcatggtgtgactgttttggaacctctatttttttctatttaaacatttgtttaaaattttatcatatgcatttgagattagcaatgtcatgttataagatatatttagatagtaaaattattatagggaggcaaattaacatctatcatctcatctagttactttttcctgtgacaagagcagttgaagtctacttatttaacaaacatttctaatacaatttcattagctttagtccccatgtggcccattcgatctctaaacatgtgcatccttcctatctgctattttgtatcctttgacctatgtctctcattgcctgccccaacccctgcccatagtaagatggtaaccactgcttcattcctatcttggtgtatttgagctcttttcaaacatatatattttccacatataagtgagaccatgcaatatttttctttctctgtctggcttctttcacttagcataatgtcttccaggcccatccatgttgtggcaagtggcagaatctcctttcttaaggttgaatcataaggaatctctcctttagagtgtgacaagttcttatttccatttctggttgccaaaggtcaaccatccagttctgaatcaaacatcttggtttgcctctagctcatcacccttgaatttgggaaagtggcctgaatcatcacaagtctgtatgtaaagcggtctggaaaatgtatgctgctgttcatctgcggatgtgtctgactttcgattctttccaggcactcagtaggctttctcctccagaattatgacttttttgcaacctgacatacagtaattacaaatcaaattctactctcctgttacatatttctgtttctcttttctttaaaggttctgagagaatcgtaaagaataaaagatgaaagaccttagcgatcagctaagaaaaataaaacagaatggtgattcaattgatacatttttgttccctagtttgcatctgtatatatctgtttgtgtatgtgtgagaaagtgtgtatgcatgtgtatgtgacgccataagggccagcagtttttactgtcttgctcataaaatgatctgaaacttcttttctttcttttcccttttacatgcttttaccttatgtctagtgacaccttatctcttcccactcttaatggcctctgccactaaattcagtaacccaaagatttattcccaaacaagagttgatctctcttttttttgtattttggagatgtgcaataaacatttctctataccttaattggtgggaagtacttaacatattctctgatgcaaagtagatgatgtcaacaacttttcttctaagtatattggaagacacttcctatcaacgatagctcagaaaacaataggttcgaattcctagatctatgagttgccagtgcacagaagaaaatgtaggcattttcttctaccaactgaaacgtgggtcttagaaaatacctgagcttaaagctttaggagggttttgcagtgtgccaagttcaaccccggcttaatgtgaatttctttaaaatttctctgccgaatggttacttgtgccacttctgagagtttcagctattggggaactcataatctcacaatccaggtttagagtctctggcagtcagctcaggctgttaggttctactcatttgtccaggccccatcccctaggccagtggtctccaaactttttggcaccagtgactggttttctggaagacaattttgatggttttgggatgattcaagcacattacatgtattttgcactttatttctattattgttatgtactcaccataatgtggaatcagtgggaaccctgagcttattttcttgcaactagatggtcccatctttgggggatgggaggcagtgaaagatcgtcaggcattagagtctcataaggaatgcacaacctagatccatcacattggatattaatactattgtacataaaatttgagttcaagtttgctatatatttgtaacttggactactggactgttcttggatggagaagacactatacaggccccattagccatccctacccgcttcttccaagccacagctaatctgtgggccatactgtcccacgggactagtgctacttcttaaggggtttgggccaggtgatgtgtgacagtattgtaaagggcgtcaagaaggcaactcactctctgttaataactttcaaacctggctgaaatgaatgaacatctagatgaaatcatccacaaaaaacagaatgcttacaagcttaagccattatggtctttgttggggtggttaacatagcacaagaaatatttaacgtgacagaaatatttctcagcaaatgtagccactgtccaaatgaaaaacggattcactaaggagttctagctccatgcaagttcgattattaccaaaacaaatctgtttaaagctgaaaattgatggctttagtgtctcttgttcctaaaaaaaaatccgctatatgaattgggtgttcctaaattacagtttaatgtaattagtcatgtgtgtttttgccccaagcttggttgtttataaaataactccaagttagggtaagaatcttgaaattcagagtgttctcttacccttaactaattgtaggactgacagaattccaagctcccgaaatagggaaacattccctgtagacttgaatacctaagaaataaggctttgtcaagtagaattggtactcagcaagtgtagatacctcctgctagtgtagatggtttagttacagtgggaagtatgtgggcacaccaggttctaagactggcctgaggactctgataacactttgtaaatatcaccagctgtgtctaaattagcctcctgtagtgtgggaagctgagtcgtgaagcaactgtttgggcagtgataaccctataatttttaacagacatatcaatgttatgtcctagagaatgttaacatgtatataaagggtaaatgtatacccaagtctgctccacatgcagaggggcataaatgctgcccagagcctcttaagatgctgctatgattcatctatgaatgcaggttcacttactgagtgttacttttatgcatgtaggtaaaagtgtacatcccacttagtcttcatcctcccaggagcctgctgcagtaggtattattttctctgttttagagatgaagaatctgaggctcacacaatttaaatgacttgcttatgagatctaaaactctgtcacctcgctacaattacatgacccatggtttccatagagaaaaatctctgtggtttgtacagcaaaaattcattctgataaaatgtaagctcacttagcattgttttatgaaaagtgtaatggggaaatgtctctcctccttaaattaactctctggatatgatataatacacaaaatactatattgttctttcagagaatgaatggctggctcaattttattcttcctggaattttatttaaaaaaatgcatctttatgcaaatcctctattcgtgatttatttcagcctcattgggaagtgggattctcctcattttggtggcaaacatctgtctctctgggcagcaaatggaaaggacgctggctctacagcaatgacaataacactctcataactcttttcctgatctcaggatctcctgaatggactctgttctgaacatagggtttgaaagttgacgtttgagcaaagtggtgatgcaaattgagtaacagtctaatgatggcctcggtttgcacaatacaaagtgatggcagttgctcaaggcacccctcatctgcctgttcctctttccttctttctgttgtgattttttaacgagatctcagtaaacacggccctccactgaccgtaaggtcccatgatttacttgctcttggccacctcacagatcctgtgtgcctcagtttctccttctggaaaatgggcatagtcaaaaccaactttctcttttgtgctattggaaaggtataaacaagatttttaagagaagttatatgcttacatatagtaaacttagttttggcttgagggaaattagctgattggtggaattcagatggagcatctccttccctcactgctcctgaacacttctattagagggtaagtaggctaaggtgggtgctgacaatcttgtttgtctgtctgccatggctttcttgtctctcataaatagtaaccatgcatcacgatgttgtgatgtttttcttcaatatcagccatctggaaaatctctctttccctcctattgtcaataagtcagtggcctatcttttttatttggtcaaggcctggtgcatattctattaagtctgtaggtttgaactctaaaatattttgggtcactgttttgcacctcaagcccaggctgaacccctaacctggacctctaggaaatcttcaaagggaatgggatggttggaagactgactttattagtgccactcatttctttagtaagtatttattgtcaacttatgtatcaggcacagttctaggcattgcaaatgcagaaaaataagatccctgatctcatagaatttccattctggcaaggggagatagtaatcaaagtaaacaaataacaaatataatatgtaataatttcagatactgatatgagttatgaatataatgaagtctggtgactgggaggccgagaaacccctctgagcagttgacatgtgagctaagactttagtgaggagaaataatcggatatggagggaaagtattccatgcagagaaaatatctcatgcacaactgtgtagagaacagaaatatgcctgtgtcctactggcattaagctttgggaggcaagtgtgacaagatggaaagaggattgacttgggaatcagaacttgtgggtcagggtgggaatcccaacttcaatttctccatttcttgtaaatgggttcatgagtagctactgcacgaggctgctgtggggcttatgtggatataaaacaactattcaccaattgggagaccatttggtcactcagtgctgctaaggtgttggtcaggaaagcttcaatctttgctttgtctaatcctaaggcatcacatcaccaagaagcccattggtcagtaggtaacatcagagggcagacatggagtatctgatggttaaggcgttggttctacaactccagaagaaaaatgagcaatgctttatggtgcagcaggagccttgggttctaaaacagtctctctgtgatcttggaggagactccctctctctgttctcaggttcttatttgttaaaaaaaaaaaaaaaaaaaaggcaaggggaggttagaatcactgctcctttccagctcggggccaggattctaagatgctctatctaacaggccataagacacaacacccagccagacctgaccaggcaaaggcaaggcaagggagaagcatgcggtgggatgtatgtgccaaggttggttcacgcgagtggcttttcattgcaggagttggaaagacaaggtctttatcaagagagcaggctgtgaacagcaagaagtaatgctgccagtcacttttatgtggctcctctctgcctatggagagtgtttgtgtgtggtggagggtggctatggtttctcttccttccacttctttgggttaggctgcaatgtttcccctactgaaaacagcatacaaaggctcccgactggggatgaaaagtcccctcatgcctcacaccttgatttgcaagcaacaactaaaactgtattcacattgcagcagcccatgccaacaaaagagctcttggacccagtgatggcacattgtttgcagagcagagctgctgccaccccagacaaaactgcgttagagacacgacttcgggcatacaaataagagtgctgaatcattctagagcccttcaatacggtgttttcctcaagattttataatacgcaatttaagagaagaacagaccaatgagccaatattcttttcagaaacatcagctaaagcatatccagaggccagaaaataattgctttttttctcccaccctctcgtacttccacctttgtttctggcctgccttgttctggaagtggaaactgtagctacccgattcaacattttctcctgctactgctgcatttttagatcgacagatatcctaaatttgctttgctcacctactagtatgtccctagaatatctcccataaatagtttatatctggaacttactctgtctttcttcttagtcatgtcctccgcttttcctcttaggatcatcattatcagctacataacagtgaaattttactaagaatacttaagaacactgagagaaaatgtcattttatatttgcatgtccaatttgcaaatacacagataaatatatcttatgtgtacaaatatgtgaaagttcacatctccatgtcaagtgatatgaagtttgacatagagaaaacaaatgtctcaaactccttttgaaacatggcgtgtgtatggtgcgtgtgtgtgtgtgtgtgtatgtatttatatagattgttttctagatcagacacagtatgatgatgtcttttaatccagttatatacggattggaaaactttaattcacaaataaatgtattcattctttataaaacaaagacttagcattgccaagcgctgtcttagtgccaagcactgtcttaggtgttagagaaatagcgatgaacagggcagatttgcggttgttgttgcttttttttatttagattcttcctacttctaagaggacttgagcagatctgttcctattaatagagcataagatattttaagacaaaaataggacaaaaaatgtctgaagcagaaataaaggatgcttttagtcacctgagttgactgaattttgaacacgtagattaaaaaaagactgtgctttccaatggccaaagcaatttagaaaccattgaattatatagttatgatcttccagttgcaaggtgacaaaaattaattttctagggaaaaaagcttctctttaggaatttatcatgttttctttaaagtttagtgagtggcattgtgaggttttataaaagataaagtactagctttcaaatgtcatacattaaagataaaaattaaaattacagataagttaaactccaatgagggcagttttaaaagaggctctgataagaactttaagatttactttgtgatatccaattctcatcaaggatgaatggctattgaattcacttaatgtgaccattaaacagtgtattttaagcaccaaatgtcttaagtgacatattgtgaagtcagtgtaattacacactttaacatgtattctaaggtaggtattgcatcttgattaaagttagagtcctaaatttctttctttttattaataaaaaggaaattctttattgggggcatgacatgcacagaaagtatgtatttcttgaaaggtacttgaatcttttgtatcactctcttacataaattctggtgcagcaaacaaccttccaatatatagttgtttatgtgcaatgaatacaggttagaaaaacctccaacatagtaaaacaacagataaatagagttaatgtgaggcagaagaacaggcgtgagacttgtagtttggatactacctctgcagttttttgttttgagacacagtcttgctccgttgcccaggctggagtgcagtggcatgatttcggctcactgcagcctctgccttccaggttcaagtgattcttgtgcttcagcctccctagcggctgggatttcaggtgtgcaccactacgcctagctaattttttttttttttttgtatttttagtagagacagagtttcgccgtgtagaccaggctggtctcaaactcctggcctcaagtgatccaccagcctcagcctcccaaagtgctgggattacaagtgtgagccactgcacctgacctcctctgcagttttgaataagatgggtctaccaagaaaagcagggtggcagcttgggtgggacactcagcaagacctggatgtgtaataattacacagaagccaggcatggtggtgcctgcctgtagtcccagctactcaggagggtgacactggaggatcacttgagcccaggagttcaagggtacagtgagctatgacatgccactatgatgtgccactgcagtccagcctgggcaatggaggagaccccatcttttttaaaaaaatagaagagagactataactgagatttcaaatttccaaattcaattttgtcagtacatttcaaaccgagaaaatgtcctaaatgtaatgaactagcttacattttaaaaaaatatcacttacaaggatggattggataatttaaagatacctgtgaagtaaaattagtagtaatttgtgtgataatttagaactctaaatttcaaatagcagttacacggaaagcaagttggcattttatttatgagaatgaagggtctttaagagaccctttagtatttccatgtcctaaagacaactcacaaggtcatctcttctaatgctattaactcacaggggaggttagaggtcttgtccagagccccataactaattggtggctgcaccagaattcattgaactcaagtatctagagaagccaaagattccaacaaataaagaatttaaacactttatttgtcatccatgttatatgtactctgtatcacagagaatgggaatcttttaactctacactgaaacaaggaataagagctaagttggatggcagcagtgttgctcatatctcctgttggtttcaaataactactatttgacctttgttcctacctttttcaagcatgccagtgattccaagcctgaaacaacctacctacctagataactaataatatcacagagaaagagcaggagcttggagaaaaggctgggcattgattccattttgtttcataagacctgacacaatttctagctccagatataaatacaattcctacaccacaaaaacattccttatgatgggatttagtctggactttctaggaaatccagtaactgatcctgcctactttctaggactgattctattcttcctggtccttctgcacttctgtcccaggcttgcacactcatttccaaacccttaccttccccatgtgtaactgagattaaaagacttgttaacttcatcccttttgtcctgaattaactcatctgaaatgtgagcacttgaaacctaaactaaagttgtaggaggaacacctaggattgagctgaaagcctactggaattagactcacgatgatggggtttcatattccagctaatcacttgctagttgtgtgaccctacacaagttacgtaaccactctgggcctcaggatccatagttgttaactttgggaaaaatgacatagctcagaatataggtgaagaacagaaataatgcctacaaagtaccagccatgtcatagaagccaaatggtaacattaaacaaaaagtgggccacaatttttaatttatttttatttattcttttttttttttttttttttttgagacggagtcttgctctgtcacccaggctggagtgcagtgttgagatctcggctcactgcaagctctgcctcccgggttcatggcattctcccgcctcagcttcccgagtagctgggattacaggcacctgccaccatgcccggctaattttttttcttttcttttttttttttttttgtatttttagtagagatggggtttcaccgtgttagccaggatggtctcgatcttctgacctcatgatccgcctgcctcagactcccaaagtattgggattacaggtgtgagccactgcgcccagccaaagtgggccacaatttcacactcatatgtctttgacaaagttttcttttttgtttttggagttagggtcttactctgtagcctaggcagtctagtggtgcaatcacagctcactgcagccttgaactcctgggctcaggtgatcctactgcctcagcctcctgagtagctgagactacaggcatgcactatcacacccggctaattttttatttttttgtagagatggggtttcactatgttgcataggctggttttgaactccttggctcaagtgagaaactttcttaggacagttctacctacttttgctcatgagactagcatccttcttcatgaacctcagtcaacatatgattttagacaaaggaaaattatgaatgttgatatcacataagaaaaagggcaaaatgagaaatcccattggtaacaccctcctcctttttttggttgtcttctagacacactgaggctatgtcaaatctgacacagcagaattattattattattattattttttgagatggagtctcgctctgtcacccaggctggagtgcagtggtaagatctctgctcactgcaagctctgcctcccgggttcacgccattctcctgcctcagccttcctagtagctgggactacaggcacccgccaccacgcctggctaattttttgtattttaagtagagaggtggtttcaccgtgttagccaggatggtctccatctcctgacctcgtgatccacctgcctcggcctcccaaagtgctgggattacaggcatgagccaccgtgcctggccctagcagaatttttaactgcttaaattggattttcagatgacctaaggctaccacaaggattaagtaatgacaatttccccatagtaatgatgttcaataacagacgagatgctgaaaagtctcctgcttagaccagatttcacggcaatcccttgaaactcatttgaggtaccatttttattaagacttttagagtagattagccttcaggctgatagtcaagtgaattattgtccaggggaccactgagttgacagtattttatattaaataattgaggatattaatccacaaagcatgcatggatggactgatgacagaagcgtcctttaaactgaactagtatccatattggactggtgggctaaggtgacatgccctctacttatttatttagctggaactgggtcactttaatttgctgtgaaatgtagtgagtgtggacaggtcagcagcatgcaccagctgggcctcatgtagaatgtcttcccttgtactgtagaagattccactggcattcccgagatccaattatgtaacaggaagataggcacttctgaatcatcatctcacttggctttctttgaggctaaacttcaactctcctctaatccccttccttctagaagaacagaagtgaagtgtatgctgctattgtgctgaatatttagtttaggcaagccagaggatgggcaagatatgcttttccattgtcaaaatccaacgggccatgaagcaaaatccccatcagggctactgtaggactataatggccatcgacagagctcccatgtttcagtattggatggtatcttagagctagcctagtccaactctctccttttcctgatgatgaaaccaaaaatcagaagtgttaaattctttgccaagattatacagttggtaagagacagaaccaaaactgctggagtttttttttttttgagtcacttttgagtattctttcgttataaagatgccaatacatactatgtctgatatgcaaatggatatgtcaaaagtaaaacaatttcaggaaactctttaatgctggatatttaacattaggtaaaagaaagagggaggagtgtgttgacttcaaagaatgtcacaaattactaggcaggataagcctatgggtgcacctaggaaaacaaattcttccctttgttcttcagggaattgactggcatcctccccaaggaacttgtgcactggactataaggagacctaacaaatattaaggaaaaaaaaaaaacatttctatttcaagctgcggctccaatatccaaacaaatatctactatataatgtgcatgtctatgtatgcatgttttgtgtatctttgtctttgtatgtgtgtatgcctctgtgtacgtgcatacctgatttgtatgtgtgtgtctgtgttcgcacaatgcatgcatgtctctgcgtacctgtgtatacgtgtgttctacatgtgtgttcactcaggcctcatgcacagcaagcaagtgcacccttcatgctggagagactgttgggctgatttgttgcctggtactgccccttaacagttttgcttcttgagcaagtagttacattgtttttccaaacctcagtgttcttatttataaaatggtatgcatgataccatgaaagaaagaagttaaccagtgtgtttttagtcccatagctattttattaattaaattgaattaactgcatttgcacaaaatttgatcatattttattataggttctataatagaattgcctcccaaacaaccaactttggcgtttccatgtacagatggcctttgtgaaaatgcatacggtttaaattaattcttatggcagctctatgaataaagcagttatctctactttacatatgagcaaactgagattctgaggtgtgagcgaactgagatcttgaggtgtagtaatcttcctggagtcatccagggaggttttggaaggcagggacacaaacccacacctgtctccaaagccagccttgcaatcattctctcctttgcctcacctctgcccaaagctgttgtgaagaacaatatggtggttgtggaactggcactggcatcctggttccctttatccagctaatgtttgccctcttctctgacacacttgtttcccttgatacctcagctggcacacgattttttagagtcgactcaccattctgccctggtagaaggagagagatttgggaaaaactcaaactggacagggaatgctggcttcatggagaagggcatatgctggcacactttaacagcacctcgtggtcctggacttgccttgcaagttttgacagccattgaactgcagaacccactgttcctagtgttcaacccaggaagaaacagaaggagaactgccaggatgtaactgcttaatcgcttcctaatctctggattctcataaatcctttaactcttcaaatatggaattaaaagaactgggttggcagaatcattatggtcacaggaggcccaagtactgagctatgaaattcagaaaaagcagagggacaagaagattgccacagggttgactttgaaaccagtttgaatacagttactgagaaagaaaagcaaatccctatttacaaaattattatttttgtttagcgagatatattgagttaattttgcacagaaaattgcatagcaaagaaacctctcagtagagccctttaaaagcaatttaatatttgtaataaggcaaattgtactgactctcaactatttagccatgaaattttaaaatccaatgaaagtctgacttcaataaatgctgctttacaaattttattgcctgtgtaacagcctaagaatactgacattctttagacagttaaatttaatcataaagacaaatactcaacttttgaaactgcccttcatgtaattgcgtataatttggtgcttttaaaacatgggtttgactttctgatatgttgtttctcaaaattgtaaataaggtcaatttacccagcagcctgcgaatttctaagcaattgtgccttatttccaagcggtcatttagaaacataaagcacaatatattgtatgacaagaagacttgagaggtttcatatctcagttattaacaattcttcaaaagctctaggcaggagttagttccatcatgaaatgatgacaccatggccgcaggtaatgtgacgcggccagtctctctgtgagagtagggagcaattttcctcattttgaaatttccttcttctaaagggcagtagatagcacactggaccagtcttcattagatataggatctaaggtctgttctaaagacatgttgcctctctcagactcagattcttccttaattatcgtaagataacgataattataatattaaacacaacatatgaaagtgtttgcaagtcaaaatccacctcttttaagtaaggcagtattaacatctttatagttgtttctctgtatacctattctcaccagaatcaaacacatgacactggccttgttggcagcataatcccattcactgtttaaagctgcccttttctattgctatagactggtcatagaatgtttccttgttcttgagagtcataaaactatgtgaatgaaccaacgtaaaccactcctctgctagaaaagcaaatttggccttaataggtctattgatggggtcatctcggccatctctctgaaattgcagactctatacgtatttcctgttcccttccacagctttgctttcctctatgacaaacttatcatcataaatatactttactttaatgtatctgtctgatttactgtatcctccattagactgtaagctccacttgggcaggggtatttgttgcattcgctgtcatgtgccttgcaccaagaacaataattgacatagaaaaacgaaggaatgatggccagcttatggttgttatacaaatgctcatatacctgcagctaagaaaacagaaatgattagaaatggttcagtataaggcttaggatgcttttaatgttttaattctaatatgtcaaggcccataaaagagtttgttcatttttaatattttctactattggcttcgtcagcagtttcttattctagaaatttttgtctgcttagttgtgtctgtgaagagggagtatagctcatgcctcatatattaagcttagatttatagaaaaacataagaaataaaagagagtttacccctccttctattagagcttatatgcaaattccaaatccactctcctgagcagttacccaccatttaatgttcataaattcccactatatattcaattgcaaaaaaccaaagcaagattataaacacactaataataaacaggcataaaatttttactaccctctcttctcacagcacttgggagatgtgtcaaattaccctgtggcagactggaaaaagggatttggggtagaaatcatggcccaactgctagtgacgcagtttccaaattttacagcttgggaatcactacgtatttaggaaactctacctttgttaattcgttgcaactgtagaagatgagcctggagggatctttaaagagagccagtgtagatggagcagaagaacaggaaaaaaaatccaaggacggggttgctttcatgaatctttaagagggactttcctgtatcgttatacaatcacacaaagagtggacagggtttgacaatacaggaagagcacacctctctctctatttaattccctcatgtttctgactccgtgagtttgaaaaacacttcattttgtaggaacttcctaaataaaactctgtactttgcttgtgcaagaagaaacagaatgtaattctatttctatttctagagccagtgcaaacacgtatttgttgcatgttgttgaagagagtgtaaaatgatgcagatggttgtggtcaagtgtcttagtgtcttccctttccacctaggattttgctgctttttttcttgaccttgacttggccacctttgtgctgcttacagggaattttccagacaaagcctagtgattggctattcgtgaattagagacacaaaacgctttaaatttatcttgtctatttccagaaagatgcaatatagatggaggaaaatgtcatgtgtgaagacatttgcttcatctagatagtcaatttagtctttaaaatgtgcatacattaacaaataaacttatttctcccttaattttgccatggaagccctttggtgctttgccatagaccaagtagccacagtaggaaaactcagctcagattgggcaattttaatttataatatgcagagaaaggcactcaccagcactgacagtgatagcttcaatgaactgttctctccagctgttagtcccaaccacaagggccaggtttgtcttcttaatgagtttgtccacagtactctagaaatgttgaaaagaaaaatataaatgctgggttcgctaaggcctcaggaaatccaagaccttgttgattttgaaactccagagttatataaagggtagcagatgttaggctcaaaacaacagtattgacatcaaacactgttatgattatgcaaacaagcatggtccttagttggaaacattctgaaatggaaacttctttgtagcaaatacaagtctccttcactgactaatgaagaatagcctcagtgtttagaatagcagatgctgcaaaagcccatccatccccctgaatgctttgccaacttgcttctctgctggtttcatctgtagtgtttcgtctgcaagtgaattaacatatgccctattcagcactacatatctgcgaatagccggaagtgacagattatggaaccaaaaaatattgctattgtattttgtttatcaatgaaatgtagccagataatggagtctccaggttgcctgctgcatggtcatcaataaatggatttgtctctgggtactattttgtcagcctcttgcctcttagagaatctcatgctcaccctattcctattgcaaacaagaatacacaaaaatacaagaaaagttcagttcttatggtttagggcacgttgcagtttaccttgccctaaatctcccctgctttactggcactgtgctgcataccccttatttttctttggaactttttaagcaccttgttttgtacaatcagtactctctagctttctaaattcagttaatgtaacaacaagagcagccaaacattcacgagaaaactaagtaagcagatggactgaaagcactactgcaagtcatggcaactacagggagaaaagtcatttccaagacactaaggctgctcatcccaagaaactaccacagtgactagtctacgaaacatccacacttactgtcagagcatccttgaatttccactaattgcaaagaggcagaaaacacattatttgtcataggtcgaaatctgtatatgttttatgcaatgtacttgagtggactatggtttaagagagcacatttccaactaactgggagtaagcaaaatgctatctaaagggcttgtattaaaggccaaaaccaaatcataatatcaagcatgtttgctcaagaagagtcattggaacagacttgaaacattgagaagataataagcatgaaagggcccatctccaactggctcactctgtattcatgacattattcttgaaagaattgtatgtccttacggtgatgacctttcagcttccagctttgtgtctagaactgctggtgcccctgataacagctgtaaccatcactgctcttggccaccataacttgaagcacttgaccagcatccatctttcttttctcaactcagccacatctcatcaagtactctgaccatcctcactgctacaaattcaaagtgccttgtagaatgtaataagaaatgacctcgatttttcctaatgtagtggaaacttgggacagttctctccaaagaggcactctgtgctgaatccatgacagagtatcccatcacctgggaaataaacaattgaacagataaacttctctaacattgagcacagactttcctcaagaaatagctgctaaagaacaaatgtttaagataaactaaacttctgtgtgtaaaactcagggtagattttaaactgtagttcatgttaatcctgggggattatagtatagccagggttcttcctaggacttaattttcatatgtatccttccttgacctatgggaaaaatgggagtgaataaagatatagttcagacacctgaacttggacactgttgtctgtatttacctaggaggttcctaaatgcttgtgatcagtttttcactgcactagattttcaaaggcttgtgaaaacctcaccctcagcaatgggtgttagtaaaaccaggtcctcagtcacaccatagtaaataagaactcagtgggtaaagcagagtgggccattgaaaggtaccacccagatttgggtctctggtacagttctgggagctctgagtaagttctttaaaatacctatgttctagtaaaagagatttcttaaataatataaaatctaggctgatacgtaagggcagttctaaaacatgcccctaacgtgccttgtaggtattaatggtaactatactgatgaactttgaagagatgactggaaataatctatggaagctatcctacaaagataagtaccccaaacaactggtttcatgtagagacttggggcactttcaaatggtcagatcattatagtggttaccagaaagggctttggacccaagaaggctttgctgcctggaagactgtgcccggccttgcttaacttaatgcttcttatgggaagttactatgattgctcttcctgtcatgggtgcatggaaggggaaggtctgagatcatcccataagggagagaacacacaattccccaggagaacccaggcaaagggcaggggcaagcttgcttcaggaataccaacccatagactctctgctacagaaaatggcactcagctctctgattccaaatgaaaagagggtgaatgaggaagagggaggttgaacacacatggagaaaagatgagtagatgggtcaccagaaatggacagtctgagattccccgacttctggaattacagggaacttgtgcacattccaggcatggttgtgcaacaagccaagttctgtgtcatacaatgggggtctaatgatcggggtctgcctagaaagcattggttccactgtttacccccggaccccctcctcctatggaaatgtgtgaaagaagagttaacagacagattctcagtggcctaaaggaaaaagattaattgcatttttatcttaaaatattccactttaatttcaaagacattttgttttccacctgtctcctatcaggcacctccatttgtgaagtaaattaaaaaataattaatggatccagctaaaggaaaagaggggactattatgagaagtccagataaaatctgaaacttctaaattggtggtctgattctctcttttgaaaccttcattctggtgtttcaaacaggaacagtgtctgcttttgaaaagtaagcaggtaaaatactgctgtgctctgggtttgtaattctggaaagcaagagaggggatgcacatttcatatcccactgcagaactgaactgtttcttcccctgtggtcttcccagatgctagaaccatgtagggtagaagggatgggaggggacagagggagcagctaaggatcaacaggaaatttcacttcaaagtcttaagctccatccccaggcccacacattcaacttctgcaaaaatgacttttatcatctagagaactgagaatccaattttatcagctcaactgtaaactccggttgcaggcactctgcattcggtatattgactgtactaaaatgtccttggatctgaagaggatgattaaatataaatgagagcttgtcaatgggatgttccatagggagatattactatccccctgcaaaacaaaagcctcctaattttcagcagtgtgaatgccttgctctgacagatttattagcattttcaaatagaacttggtttcttccacacataacaatctcttaggattcacctttgcatgttccttgctgcccctcagattaaaccttccctttggggcacctctgaccttgtgcagtcatagatgtctcctgctgggccctggttcggatgctgtttggtttacaggactccttggttcctgattaactctataattccaatttggccccaaaggctctcaattcacaagccagttcctgaaattacatctactactctttccaggtggatcttaagctttggccaaccctatgaacagtttctgtcccaaggtgagactggctcctggtgggcagtgttggtgagcataccttgaattcataggattcttcaatgatcacttccaacttggtgtgctctcccaggatggggcgccccatttctgcaatgcgcctctcctcttcctctttgctggtcagtggctgcttgtcatcatattcgtctgtgaaacggaagtatcagagagtgagcactgtgttctgtttaatttggaaatccctggatcctgccataagaaagccaaggaggaaggaagccctaatgacctactaaagccccctgggtgagatcacgatgctggagggaagagccagacagacacttggcatgtaaggcagcatatcactgtgagagcaagtgattataacatctcacaatctaagctcatgcaaaagttcagttgaggaaaagtaatgtatggggcatatcactgagaaaagactctgcctgtacattgtctatggtaagggagtcacgcagctattccctgtgacgctggctcagttggctgtttgtacacattctttcagcacgtgaccaaagggaaacacaattgaaagtgctagagtgaccctcagagatggcggagtctggcctcttcctcttcactttctaggggcaacagaaaatgcctgaggcccaaagagatggggaacaggaaattctgactttagcctctctcttgccaagagaccctattgcaagttaaacagcaaaacatccattccatatttctgtgagacgcttgggctccagtgctgcttcagtctggtgcaaagccaaaatttgttaggaaaaccttggccatgttaatcttaaagtaaacagggagggcgagggtgaggcctttcgggagttaaaatactcactcaccatgtgagcacaattatttccagaactaccatgtagcttacagtccaggagaggacggtgggtgctgaggaaatgttaatggatccaagagcccattaatgaggggaagctcacagttggctctctctttgtgaaggtcattaggataaatcccagactgaaaaggccatgcatataagaagggcaaacactggtcctataattacccttatcctttaggcccagaatgctgaaacaagacaagctacttcttctcagatttaagtggaatgaacattgtctccaatgaaacattatctgatatggaaagacctcagccctgatggcctcatttctaggacctctggacaaagtgcctccaacagggggctgttgactaaaaagacatgcaataaaagggatgtttggtcctggcttcctgcctggtgcatttaaatattagcttctgtagaagtccatacctcccattacctccaaagacccatggcctcccccctgctgagggaccacgctatggtggctccattgttgctttggcagctgttgcagggaatgaatggttcctaggctagctgctcgttgtgagggcagggagtgaatgagctagaggcagtgccagcatttaatatttcaagggtcaaaaccaacaaaaggcaaaagcagaatgtagcatattgattaattctttagtatacattttatagtgtcatcctaaaagcccattttaaaatctgctttcctagcctcagagattacagggcaccaaataaattagttgcagactaaaaataaatgattttggactggccagaagctgctgaatgttagcagaggcaaaggagaggggcaaggagattaattttaactataaaagtggcaatattttttatagtaggattgggaagttatgacccaagggaaggcaaagagttctggttctccaagatttgtccttgcaaaattatgtatgtctagtcaagagaggtggctgagatacatgaagtgcaatttatccagcactgaaattaataatgttgattaccactgctttgtgatccttgaacccaggataatgttattagtagttttcatagcagtagtttatgctagcatctttgtttgaaactttggctgaacatggatgagttgaagacttacacagaacaagaatggttttctcagaagaaggaatattacaacttggacatctatttaaactgtgaagctattgggggagaatatttattatggccttctttttgtagtttacttataaatgacaagctgcttttaatgggactcaaggcaatctacctagaaaaaatagagaaattacaaaacaaagctgatgtggtagcattgttaagtgcagcatttcatgaaattaaactggttttgatcatggtattaaataactggacatggaataagcaaatgaagtcaaatcatacaatgagtgaaaaggttctttcttttccaaaaatccttcagtccttctgatcaggaagaaatgcttaattcggtgctgttaggtctgtaactagttcctagtatctcgacttttgtaccttttaagataggtagtcaaaatagttctcaggtgtagagcacttgccatcatctagctagaatttaataacttttttccattgtaaaaattttttaattttactttctatttgtggcaaacgatactagttttcctgtgttagtgacttaaagttttcttttaaaaacaaacttaataaagtataaacatgaggcaattttaaaaattacattaagtaaatagtatagttggtatgcaaccaaagcagtatgggaatgacaaaaattaagaaatatagtgttaacttatttcatactaacctaaaaaacagtaaggcacactgtttctatcatttgctacactcttgcttcaaagggacttagatttcttaattccacacttttatccctttatgtattcacctggacaagcttcacaattttcattttgttaaatcttatctttcaaaaccccacctcttctggcaggaaataactccctattgatgagtgagaaggtttatgaactaccactctaaccttatattaattccttaatattcgttgtgtgtatagaccatggacattttcatagactgtttttaaattttttaattatctttacatataaatatccagcacataaactcactgagatagaacaataagtttcattgtgctttgaaccatccttgtatcctctggcacctattacaatatatggaatatagtaggtgctcaataagcatttgctgtgtgactctccaactcactgttaataaagcctcttagttgctcaacccatacaaaacggatcattttttcattgagcacatctcattgtactccataccatgtcagcacttcctcctctactttccaggaacttatgatgtaatggggacaggactagacaatgggcaacttctaggcatgataaggactaggggaccagggttggggaacaactcagttggcctaaagggagtcagggaaggaagccttcctttcctgaaggaagcttcaggaaagaggagctatttgaagttggccttgaagcacatatagaagattgccgcccggtgaaggtgatggtaaggatagataggaggtggtggaatgcggaagttcattccaggcagagagaaatcaaagtacaatggtacagggtcatggaagggtcagggcagttttgacttaagtatcataaacttttatttatatgtaactgagaaatggcagctgtatagattctattattgctctacagttatactgataaattcacatttatggtctagatttttgactggcaaaaatgagagccaagtctaatttttaacaaaactgttttctgtctttagatactttctgttgaatacggaaatggtttaacagcatttttaaaattttaatcatctattttgtttccttttctcttggagcattggatcaaaagcagatcattttactatggttgaggtcagtttcatttctttacttctgcagagtgagataatatgctgtggttttagttttctcagatggaaaatatactctttctcctcctgagtgcacatgcacacttttaaaattcaccatattttattgagaagttgggaataaattacataacatcatagtcttaaccaatccaaacaacttaaagatcaaatgcataattaacagccactgctaaaatcaatattgacaggacataaaacagtcctggaatagaatcaccagtgggggatctcccttctcctgagtaattgattttgcaagcaatagcaaataataaaagctaataggtacctggcatctggggaaagcagcattttgagaaagctgtttctaacgctctctggttcaagctgtattttgaagcagagtcagtgtaagaggtgaagtgctgagagtgggaaaacaacacaacccataaggtccatctcattatcaagatctctacctcaggggacactgttgagagtcttcaatgtagtcacattttaaaactgtacaaacaacgtagaatttggagaggcggacaaggccagtggtgggacaatttgctccagatcattttgatcctccactcagaactatgctgacaagtcagaaagcagaggtctctcctgacaatttttagcatgtggctggcctctttgattggaggctaaagtgactgatacagacccaaatatcattagagatgatatttgggctctaaacctgtattagatctgggatagctgtgtaatcctctagtcaccctgtcaatgtcatttatttcccctgtggagaaaccccacagatgtactatcatctgggcatatctggctaacatcatgttgcctgggggcagcaagggcaggctctgggaagaaatacagctcagctttaaaagaaacttcatggttgggcaccatgactcattctggtaatcctaacacttggtgaggcagaggcgggtggactgcttgagcccaggagttccagaccagcctgggccacatggtgagaccccgtctctacaaaaagtacaaaaagtagctgggcatggtggtacacacctatagtcctagctactcaggaggctgaggtgtgaggatcccttgggctcaggaggttgaagctgcagtgagctgtgattgattccaccactgcactccagcttgagtgacagagagaatccccatctcaaataaaataaagaaacttcattacacttgggataaaaactgatgtgcgagaagaaatatttccaagaaatctggaatacattaaaactcaggaaagagaggccatgggatcagtcttctctgcaggctgggctggtccctactcagtgctccttttctgccctcacgtgcttgtgttttgttgtaatccaccgtaccactggctgccagagaagctgcagcattatttagcaatgttttacagaggagaggggctaaaatgcatgactgtaatgtctctaacattaaagaactctgggaggctgtggttttcaaggatcatgatgaaatgagtacctgcaatggtgattacagtagagagaatcggatgttctctagcatgaaccttcctgaagacaggttggcctagcaaaaggacaggcagaaaaatcagcagaatggattgcattgatttgctatcagagctttgtggaattagtaagctaaacatcacacccagatgcacacatcacaagcaacgttagtttggggattcaatgatcataggtcacccctaggtaggtcacagaagggagctctggtggaagttactgatggagatcactgctcagagatgagcgagtatttcatgagccaaacaagactgtgtcaacaaaccacaagccccatggtagtgagtacagccagattcctacaggtatcttaaatgatgtgtcaaggtccttcaaggtaccgcttgcagaagcatcatggaacaacaaaaggtatagtggcaggtgtcgtggttggcaagccagtcttcatgactgaattgaagtaataatgtttttaagtcaaccattatagaaatagtgtactagtgattgggaagcctattagtgccaacaatatagccttgtgtaggccatttctccagtttctccccatgtaaaatggtgataatagtacctgctctgtctaagacaggcagaatgttatgtacgcctgtaggttttgcagaggtaggccatcgtcacagcaactgtttggataacctagggttaacctaggcctagggggttctcattgaactcctggttcagctgacttccagattcacttgctatttgcctctaccaagagctacccataactgacctgggagtcatgagatttgggattcagtgccacctctgccatatgcttgtcatctaaacttgggcaaggtctttctcctctctgactctcaggcttctcagttataaagtgaagctgaatttgaacaggctttgttcctccagcctacagactgaagtgatgaaaacattttcaactgtcagaattttcatagtttggcttccttaaaaagtcttgtgtcttattaagtctattatgtgctgagcataataggattagaggagtaatattaaataggtatactgactgatttttaattagagaactctatatcttagaagttttggggatcaaacttacattcttctctccatagtgagccagaatacttaatttattaaattattcatgtttatatggtccagtttccccattctggggtacttctcacttttcacttaactggaagtcataatgatggaatttattagatacatgtgggttttgagtagaaaaggggttcaatgtataatttcaagatgcaggtagaaataagctagaggagaggaaacaggacagtgctgggattagaacagtcatcattaatttcttcaaaccttcatttcctcccctatgtgtgagaacaatgtcttactctataagattggtgataaagtgatatgatgaaaaagaaatatttacaaactctaatgagttataatatttagagtgttaccttgtcgtatgactggaaggtcaagggggaatgagatcataggcccaaacaagggcctttcaatgaggcaaggtctgggaacaataggtaaagatctgcagattccaaaagcacctccaacacttaatgtccatcactaatgagatctctgaaatattggtattaggctgtggatcagacgattttttcaatttccatatattctgcttcaaatttagattttcacactcagctgcgcaagtccatgtaaaagctgcaggcaaagtcccagggctagattaattcttcttactgcccctgcatctcaaagccttgactttaaagcctccaactgacttccaagaaaaaaagttctttagggcttgaagctgcttttcgctgtagacctaagttttagaactgtcctcaggagcatcagtagagagtggctcctaggcattctggtttgatttaggaaaagaagggtcatgtaaagtgagacgatttcttagaaagtaggaatggacaggccagtgtagaaattcccaagttttggaacattctcttgttctaactgcattaatttcaagtcttaggaagaggtgatggtaataggaaactgccatttcagattacagtttcagccataggaagaacttaatgaactaactacatgaaatgatagaaacctttgtaggaggtgattctgtcatcttggatgccagttgtggccgaggcaggaaaagttggatattatcagacagatattatagaatttgatgtaaagaagttctgagaaaagaaaactaggatcccattacctgagatattaaaagggaggacagttcaaatgacatagaaggaaggcccttaaaacaaaatttgggccaggtgcggtggctcacgcctgtaatcccagcactttgggaggccgaggtgggtggatcacgaggtcaggagattgagactctcctggccaacatggtgaaaccttgtctctactaaaaatacaaaaaattagctaggcgtggtggcacgtgcctgtagtcccagacactcgggaggctgaggcaggagaatcgcttgaaccctggaggtggaggttgcagtgagccgagatcgcgccactgtactccagcctggcaacagagtgagactccatctcaaaaaaaagtcctgacacattcagtaataaaacagaaagatattcaaacacgtcaatgtgtttttgacgtgtggctacagagcatcctagtagccacaagtttttagttagggtctctttatcagatttcacaggatggaaggtgctgttggatagtacactatttctataatggttgacttaaaaacattattacttcaattcagtcatgaagactggcttgccaaatttataccttcttcaaatctcccagggataactcatttatccttgggtgatagaattagagtgtttacaaggggacttcaagcagttaaaatgatggaatgagaaaaaggagataaaagtttaaaaaaaggagtataaattcctgcacttgacttaaaaaataacctttagtagtgcacagttggggacatctgacccagaagagcttcagatgaatcagatttaagaaatccaacacaaagacttgtcctgtttaacattcttatccctttcaacttctgtgtgtctcagagtctatgaatcattttgtcattaaatgccatgtctagagagaagcagtggagagcaacagcccatgtgaaacggcccacatgaaactgcacatatttagaaaattctacttcggacagaatcacattggaattgcttgttcatgagtttacactaacagtggattaagttcatcccaattcccaacatagtattttcatgatcagaaatttgaagtatattttcttctaaatatttttgttcagatctctgatttcaaaattttgatatctgcacaatatattggaaaattttgatattggcacaatatattggaagatgtcacatactgatatagaatgtaggccattaaagatatcttcaacctacagcttcagacagacctactgtttaaatatttatctctctaaatgtgcacagatgactctaaaagggtgagaagatatttagagacaacagaggatgctgtaaggaaatatctttgttttgtacacaagaatatagttttagagttgtgctaaataatgcaatcaacacaggctgagtaccattctaaatttaaatgtttgaaactttttaattttgacattttgagtttttatagaatactttgtaatatgcttcaagtggcagaaatattactcattaccatgttattaatactaaaacctaagtccccagagaaaccctcagattggtgtggtgggatgaggggaaggctctgctcaacatgatattatattatgtattataaattatatatttacatacataatttatgaattaaaatttatgtgttaaagtgatgtatttttacgtattttctcaacatgtatttttatgtattttctcaatatggcatttatgtgttattaggatcctgagcttggaccacggatccatcttggatgtcagcttctatgtttctctgaggctagcaattgtgtcaccttattctagagctctttggagcctctatcagggaactgtacatcattagcactatgtgaacatttgtaaattggtcagtgtcaaaatatgaacagttacagtttttccatatgaacagcttataaacacaacacacacacattattaatttgtaaaacgttaaatgtgtaaaaccagcaagagcacaccatgtgccacagttaaatattaatgcaagttacataagatgtaggtttggattgatggttaagggtatttggggaaaaataaggaacattaaaaaaataagtcttaccaaacaggtattttccttcattaaaagcaaataaaaatgagaaattttttttaatgtaataacatctggtgagaacagacagtaaaagttagatagcattagacttgaaaaattcatacctgttattgtgaagccacctaaaaaagaaaaaaacaacaacaaatgttataatttgacactctacataacaaataccagtgacatcagactgcctgacaacccacccaaggtacttgccaaattatatttacaattaagaagactaggaaaatgttcatgactgaatcactaatcgttcttttaagattatgagatttaatgcacaaatttaattcttgtgcatacctaagaaatcaccgatttttcaaaaggttgtactaaattaaaaatgcaatataaactatttgaccttgacaaaatgaggtcaatggccctaaacaacaatcttgctagcaagtcaagagaaataaaagtcacagagctactgtatcacctgacggaaatggaaaataatctagaaaaatggaaaggaaatgcaagaaatgaaatgcttaccaagctcattcaataacagggctgtgaaggaaacagacaaagacaaacacagaataagagaccagatgaataatgaaagtaagaggaatatcagcagaaagaaatccaggcagatctgattacagtggtagggagccactgctaaaaatgggtataccccaaagaaatatagtgatgggaatatttctgaataaacaatcccaactgaaatttctgaaaatgtgtgtgattgaatacatacgtatatgtgtgtgtgtgtgtgtatatgtatttcaccttatatataatttctttacatttaataagacattgctagtatatatgtttatacctagtatgtaaatctagtttaccaaatacagtggaaacattgtatgaaattcattcttaacttgatatgagtgaggcttcctcattaaatattgcctcggatttggtcaatccaacatatggaagtcttaaatcacccaggaactcaggtatcacaccttttattcagtaagtacaggtgaaacatcctgggacattccattttgggttccctgcctggaaagaaagtttagcccaaggtaaagcactatcttgggatgttctatttggatgatattttgtccaccaagaattgcttatgttttaaaatccttaaagcttaatagtcccaggaattaacacctacttgtgtccttatctgtgacttctgtacattattagataaccagaatccttctagtggacatatcatcccaggaaactgacagggcattgggttggggggagggggacgtataatttgtctttcagcttatgtgctttaagcccagaatgtactgtagcactttattttagtaaaagcaaccttgctaaatatatcaaattatttcctgagttgaagacgggaatgttacagttacttttttgggcccagttttctctctaatgatggtggcattagaggatactttctaaaaaaagtcagtaatttattaatagtgacaagaatccacttggcgggtgtgaaactggatagtgctattaaggaattttaatttgctgttacatgagagcatattttactaaaacggcaattgtaagagcagaatccaagatgctcctccttgagataaagttctttggaggaatacattgagaagaaagtgctttctcctgtatgttaatgaggcattttggatcccatcttttaagaaatcagcataattttctggtctctttttcttctgtctaccatctatggagcatattaaataggcttcattaaaataggccttgagtgctccttttcccatcactccaaatactccaaatactccatcttgaacttgattaacacagaaacatacgtgttttttccccaccagcggactgtgaggccacaaacatgggatgaacgtgggataaattttcctatgtgtctacatagcaattagtcctatatattttatttttccctctacttgtaaaagcataaatttcttacaaagtggcccatctcattatatcatactgctctcaccaattgtttgtatgcaactaataagagctattaatatgtggtctgctcattttacacaataagtaaatcaccagaattccttttaaaatggccaccattagaggataattatatgaagccctatgaacaattcagaataaaaaatcctctgtaaagctgatacaagattgctgtctttcctatgaaatatatgccatatattaataatcagcaaaatcggcataatctagttataaaggacactacttttattttttcttttttttatatgtgttaataatttactaattctgtaattatcaagagattttggagcataaagctaggtaggctttggtttcatagatatggtgccttttaaatgttgtatttgatgatataaaaatatgctaaaatgagcactagaatattgaaaatactactctttaaggatctttgttcttattaaatatttttaaactgtgttctccaaagaagcctaattatttgaattctgaagtttcctgttagttgccattagggtcatctactaatactaataggtattaagcagtttcttttttccagctttattgaggtatgattgatgaggtattaagtcgtctttatcactaaaattttagggaagatttaataattggagtgacattttagaataaaccgtgagtagtgaaaaactaaacacattcttttatgtaatcatttctgaattacagaaatccctttcagtgttattaaatctggttgcaatcaaggttagttggcatttcctgaagaaagtgggcgttgcctgttgcacttgtgaattagggaagggaaatgaaattgctaaagcttcaaaggcaatgaagtatagtacttggaagccgaggaagaggagagagttaagtgtgagagtagggagacacggagagagaagagtacaatttctcgctggtatgtctttgtttactctcacacctttcattcctcttcttatccattttggttcctcaagcacaagggagaaactgcactctttctcatattcctcacggtcaaatattctaatggtaatgatcttcctgtgggaacacaagacaaaggcaaaacaaatggttggagtcacacgctcatgctcttggtgtccaccaagctgaatgttactgtgatgttatggagggagaactggcagcacatgggcctcctgaagtatgtaaaagggcatcttgggtactcttggctggcccccattaagttttctttgctaatttatcactttcacgaattattcccgcttcagttagcagtcagtaggtaccccattttggggtattttggcatggcattgcatggcatctgcagcaactttcccagaaatggatgcttgattgactgccctgaaaattaatctctcagacgttaatgtgcagcgcacctaacgctggctgatgtagctacaggcctgcctactgtggctcagcatgagatctgtgccctgttacataggtggagggatgtgtgcattgtaagtcatgttctgaagagtgcaggcatccaggggtggcacaggccagcagaagctgttgggctcagccctggagcagctcccccacctttcttctcactcatctccaccaggcggggctctccaatctcaaggaagaaggtcttgtttttctcatactcctcatcatcaattaccttgactgatattgttttgctgaaacagagaatagaaattgacgaacaaggggaagaggaaagagaagagaaggaacatagagaagaggaaagcaaggttaaccagctgcactttcagacaaacagtaatcgagaaacttctgtactgtgagttttttcttcaagaatgggtatcagataggtatgaaagatcagagatttcacccaatgcatagctcccctgagcagggccacagaattattttaggcaaaatatagcattcagtattaataggtttgtcatcatcataaggaggaaaagcagaaaaacacagatcacaataataagaaaagaaaaacacattaatttagtaaatgccttaaccattggattgtctaagctatgccctggaactcactcctttagaacaagtcaaaaaatcccatcaagatattaatagaagttatctctgagcaattggcttacaggtcattttttttccttcactgtgctttattatagttccaaatatagtatttttatcataaattgttattaaaataataaatgaataaaaatatcacaaagaaaatatagtcaagttatttcaccccacccaatgtcttagaatcaaactcttattcaggttagtcagattctccagctagaccacagcaggaagttgttcacgttttgtttgtctttctaaagatggaagctgtggcctcacaacagctgttgtgaaagtggggtggcagcaggtgcgagtcatgatgttgtagttattttcattcttccaaagttgagttttaactttctatgaaacatgccatttacactactttcaaacatcaccgatacaccaaggtgttttgattagaattcttcctgtaatccaacctttaacagttcttgccttatggcgctatggctatgagtgactgacaggcaggtaggacaaatgcaaatattatgcaaatctcaactttccataagcattcttgatgactctgaaaataaaccaacctaatgttaccttataattaataagggcttaaacaattcatatactacaactaacttattagaagcctcttaaaccctgatttgtcttgaaaaaatgtttccagtaacattggccaagtacaattctgatcaatgtttttgaaacaatgagtgtttgtagacaacggaattttaacagcatggccattctttaattttggtggagttttttaggtcttctggaaggaaattggcttatgatcttgtttttattttatttatctgagccattaagtttcattagatctatgcatactaaagaatatcagtcttctttcctaatatgaaggagtcataggtagaagatgcttttaattctctgaatttcccagcgcctaatgccaaatgcttaagtcttgctttttggcttagcattgtagacctgagaccaaatgattggttctggttccctgaaacccaataacgtactctctgttcctcagctaaagaacattcttgaatgatactcacattccaatttctcactcctaaaaagctgcagctcatgaaactcctttctatctcatttctgtcctcaaatactgaaatatgaacacactagatgaacagctataagtgactaaagccacaatcatcttttaaagagtggttagatatttacaaaactaccaacagtatgataatgtccagttacatgtatactgtaaacagctccttcctgacttttagaattattttttaaatttgcatctttagtataaaaaattattctgctgtgactaaactagaatatttaatttttccctaatatccaaaaattataaaatattagagaaggcacaggaggatggatgtaaggaatgattgattatttgataattagaactgaatttgatgttgtaaaatagatcaaatttgctctacacaaaactgccaaatgtctgtcctctttgtcaacaaaacttacgcattttgggtattaatttccatctcacagtcttgcaatcttaaactttagtggtacatttctacaaaaacaaacagcatggtgagaccaagggtaggaaagtgttgatggacaataatagggccacgctactgttctctgcacttgatggcccaacatccattatcaagatgcttcattgtagggtacatcaaactgaaacccctcattgtgagagtcacgttgcaatattcttgttagcattacttaaaaacatctgacgttatatttctccatcttgtatttgcaacccaccctgcatctcatcacatattttattggattatagaagtaaagcacagtggggatggtagaagtagccttgctaatagggtgaatgtttgtgtagaaaaggtacctgtttcatgttcacaaagcaacttattcacaaataaataaatcaccaaacaacatattgtttctaatccttggtgaatatcataaatatttaaatcttttaatagctttattttctttctttttttttgttgagatggagtctcactcttattgcccaggctggagtgcagtggtgtgatctcggcttactgcaacctccgcctcccaggttcaagcgattcccctgcctcagcctcctgagtagctgggattacagatgcccatcaccatgcccagctaatttttgcatttttagtagagacagggtttcaccatgttggccaggctggtctggaactcctgacctcaggcgatccacccgccttggcctcccaaagtgctgggattacaggggtgagccaccacacctggcctattttctatactctaagtagctgatgggtgtgggaaacacagttatatagctccacacaatttgtttgcatataaaataagcatttatgatttatcactagcatatccctagtcataggatcacaattcttagaaaattttgaagtacttgataactatgatactggaaaaatcaaagatgaagaaaaagaaaaaagtacttttgtaggtgcctggcaaagacatctaaaacagatggaatttgcataatggcatatcatttcaaaatcattagtaatggaatcaataatgctcctgacaggaagagccactaaattatatattgatttcactcctcttgcacagtaaagctattaataggaaacttgattattaaaggacatttcagtggatctaaagtggcaggatgaagtcagtccttatgaattagccctttaaatcaacagaggcaaaaatcagaaggcactggtaatgttcaccttttgcttcagaacagaacaatttctccccttagcaaaggtagctgaggtgaaataaaccaatgtaatttttaaaggaacacatccttaggatgtctccttttcaccttccagagcctaatgcatgaaagatactgctaccacttcttccttcacaggggatagtatggggttggtttggtgaagatgtcgttattttggcttgataatcagcagaagcatgttcctcacagttctgcagtagaaagaatctcaaggactgacggaaccttgaatgtcctccagttggccccattgccacaccaatcccatgtccacaggacttttgcactgtcacaaggactccagctccctgagaacctacatccattttggctgttctgttctgtttaccaacgggaaacatagctgttgctacttcttttctttaaatagacaggttaacaaaatcaagactggaactgttgggtagacacagtccttcatccaaatataattcttgcatttttactgcactgataaagaacaaatagaaaaactggtatcatgcaactttcaactattataattattataaagacaggaaaactcacttcttttttacagcttttcaaatttgagcagtatactataaaaactgtggtttctggaaactagcaaagcagttacaaatcttacgatagcattgaaatatttcttaatatggccaaaatttttatggaagtacattttggttctatttctaaaaaaaagaaaaagaaaaaaacattcggttaagaaagatcaatttattcagtggaaaaatacagatcattccttttgaagttggcagtgccttttatttgatgataccaaaccaacatctatactttacttcccagtctctctcttatcttaggtgtctcaaaggacctgaacatcttcaaacagactaccaaggagttcttatatctggttttgactcaggcagacagtcagaaaagaaagaaagatgtggctttattaatgagggttgaaaaagaaagtctcttcaaaatatattttagtttctcattgttaagccaaagtggtaccacagtctctttttcaacttaagcctcaatttgtccttctatggtttcttttctttaagtctgcccttgatgttgggagaagatcaggaaaggatgaaatggaggattaaagagaagagactcctccattttagatccttacacaaaagattttagtgaggatttcacatatttagatgcttacagttgctttttgtcttttaaggtttaccctctccttagatattctcagaggccagtggaatgataggctctttgcatttcttaattcacagatcttcataacagccctagaagtaattcctactacctgcgattgacagggaaaacaatgactctcagagaagttggtaacttccaaggtcacaaagtgagtctcctgtgactggcttcaggaaccaaaacctttcaatcatatgactcaaaattagccactaggtcccttattcattcaactgtgcagtatttttatggccactttaaaggatctggatcattaataacgagttttattgtttcgtatttacattaacaaagaatgactgtatgaacaatgatagaatttcaattctgtttttaaaaggactgcagcacacgttatattccatgatggctgctttaaaaagttaaatcattgaggagataaaggtttaattaaaaagagcgatgagcatgcaatggctcaccaactctgaggactctgaatagttttaaccagctgtctcagcatcagcctcacctaaagtgggggacttgttagaattgcagaatcataggctccatccaggcccacagaatctgcattttaacaagatccccagatgactcttatgtatgctgaagtctgagaggcaccaatctagagtggacaatgggttcttgttattaagttggatgataaaccaataggctggtagtagttgggcttgtgttttggacccagctgcatattagaatcacctgtgggattttgcaaactagaaatacctaaacccactccagatcagttaaatcaaattctgcttgtgggagcccagcatgaatatatttaaaaagtttctggataagtgcagtggctcatgcctgtaatcctagcactttgagagatcgaggtgggaggatagcttgagtccaggagttttagagcagcctgggcaacaaagtgagaccctgtttctacgaaaaatcaaaaaaacaacacacatgcaaaaaaaaccagatgggtgtggtagtgcttgcctgcaccccagctacatgcgaggctgaggtgggaggatggcttgagcccaggaagttgaggctgcagtgagatgtgatcatgccactgcactccagaactgcgagacagagtgagacactgtctcaatcaatcaatcaaccaataaaaatgtttaaacattaaaagttttttaggtgcttctaatatgcagccagggcttgctttaaaaggatacattaaataataatatacataaaataaagaatatatagaattgtgagacagtaatagtccaaactaaattttagatctaattagcaaggtaggtggaaacatgggaagatcattttgttttgtcttttactcctgctcttttctggattataaaatgtacttaaagttgttttcccctctcaagaaatgacggtctctgcaggcaaccttaatagtataggtgagaaaacacctttagtattcaggcatcagcgtttacactcatgcacagtgatttccttctcaagaaagtgatgggagctctggcgatacgtttttacacaacagtgattatatctggaaagtagacaaactaagcatttcagttgccgcagaagacagtaatgcctcatgtccctgccacagagcctctgagccatgtcaatgaagggccatgtcgggaactggaactttcccacatgtaagccatcacaatcccagactccagaaagacctgacccaggactgaccacgcatgaacctggcaagttctctgaccacaaggagtttgaaatttaatccacagtacacttgatgttaaaagcttcaggataaactcctcttacagcttacaaagacaaactaaccaaaaacaaaaaaaaaaaaaaaaaaaaaggaaaagaaagaaaaaaagatgggcaaaggatctgaatggcatttctccacagaagataaacaaatggccaataagtacataaaaacatggtccacataattagctatcagggaaatggaaatcaaagcatctgggagataccatgtcacacccactaggaagactacgataaaaaagacagacaataacaagtcttggtgacaatgtagagaaattggaaccctcatatgctgctaataggaatgtaaaataatgcagccactttggagaagccctcaaaagtttaaaagtagaattaccatgtgaaccagcaattccactatatgccaaagagaattaaaaacatgtattcacacaaaaacttgtgcatgaattttcatcgcagcattattcataatagccaagaagtggaaacaacttaggttcatcggctgataaatggataaataatatgtggtgtatccacacaggggaatattattttgcaataaaaaggaatgatgtagtgatacatgctacaacatggatgaaccctgagaacatcattctaagtgaaagaacccagacacaaatggctacatgttgtgtgattacatgttataggaaaagtccagaataggcaaatccagagacagaaagcagattagtgattgcctcaagctggggacttagagataaaaggccgggtggggtggagggagttggtgactgctgatgggtatttggaataatgaaaatgttctaaaattgattgtagtgatggttgcacaattctgaggacatataaaaacccaactaattgtatattttaaatggttgaatcctatgttatgtaaattatgtcttaataaagctagcatttaaaaaaataagctttaggctaaattctagtctttagaaaaggctgtttccttgggtgagaaaaggttgtcagaatgtttggagttttcagtaaggagtttcaaattttgctagtacagccaaatagaaaactgtgatttccacagttttcatttacatgaaagctaagcgccactgctgtgtctgtctgtaccctactcctttcctcaggattttgcatagaatgctggttgccccctccaggatcaaggactaagttgtactttgacacactaagcagttctggtggctgttacctcaggctggcttccttgactcctttcttttccccaaaatataaggtattatgaaaatgtcagaagcagcttttcttgcattgtgtttactataaaagcaaaggaaatgattataatcataaggaggcctgctgcctttgcaaagtcagtagctctgttcatatcaccttgggcattctctagttcttttgttggcatttatttcttactacctacaggagatgatgagcttgccatgggttgcctttgtatcacttggtttaaattcctggtgcatttttaagcctttttttcctttcaaaagttgattggtgagttgcttactgatttggggttagggaaagggaggagcagtcagagaagatccatgcatatattatcattttctgtaagtgacccaaaccaactcctccatctagtaaacatttcaagtggaataaggacaggttgctattcatattatttctactaatatttttacatcatttttagattactggtgagatattttgggcatggattcatttggggggatagtcataaaaacaggactgaatcatgacttaaatctattgtttcctttctcgaaatcttgagagaattaatccagaagtcaacattacccaggtttgtaacttggctctgctactttctagccaaggtatttgggtcacttctggcatccttctaaacatcaatgttgtaaatctatcaaatgaagataatagaacttacttcacagtgattatgatgttcacagtgttgtgatgatcaaataatggttatcatcatttatcaaatatggataatgaaattcgcaggttattgcaaagattaaataatatattgcatgcaaaaattattttgtaaagagctaatgaaatgttaggtactattattcttattagttgaaaaggagtggtttgttttgcagttcttgcctgcctgtttacccagttactaaaaggagcaaattggcagatggtagagttgtgggtcaggaaatattcaatggagtaataagcaataccctcaaatccactctcatatataactttggatcaaatcccatataatggggcatccaagtccagaatccgaaactcaagaacgcagggagcacagctctgccaggttctcattcaccactagcaggatacgcacagggatctgaagtcatgcttttcctggagctcctgctatgaagcctagcctgacaaacggtggtggtgctattctgtaatttaaatagactccaaggacaagagttgctaaagtagctaaaccaaagtaattctccaggaggccttgttgtccgtgccctgatcttttggtattgtcaaatggttattgaaatcattgcttcaagcagagcaagagacagcgacagctaaaatcctgctgttcccagggagaccaagggagctttagagagttctggagttggggttttctaacataaccttgccctattttactttcctctgccaactatggaaacttaatggcaaccagttcattttgtcaaatgcaaaataagaataaatttagttctttagtctatgattttagcaatcaattgtcagtgtcagtgtccaaaaaacaaatatatgagctacttttctgtccctagaagacattctggttgactactcgaaagagatactacagggatccatagttattgtttttaataaataataggctagtctgtctagtatccccacaatgttctatgctattatggtaggtttcagagaagatcaggtgagtaagtttgctaagacaaaattacatgggtgtattaaaaattgaccataattttgtgatatataaaatgtataccttaccattgcctcactcttctgcagttgataaacttcagccttaaggagggtaaagcaataaggacctggggtctgttacctacacatgcctgctgagaccatttctctgctcagtgaaaattaaagtggatcaagcatagggtaccatgttgaaatatggcaaaatagatgcaaattgattttttattgcttaaaaatactggcattttgcaaattctatgagagggtcacatttaacaaaacgatggcagattcttggcatcgtcaaacttattagttaacattcttataagactacctatttttctataatctgagatcttaactgtactccttaaatgcagattctctagaaaataatattttaacaaaatgttcaaagtttaaggtaacgtttaaaatgatttgtggcaaagagcatcttttctagaaatgaaacacatcaacatctttgtctggttcagttttagaaagatcagttctccatttgccactgcctattacgagaatttagaatgacaatgaaattgatgctgctggatttcagactgctggttgcccaaccttttcaaaagctctcttcgtcctgaacattttaaacattcctggaaggtcatcagactcgttccagagattatttctacctttggtctttcttcctatgttacgtttcttttttcaaagtaaaaagtgtcaaggaaaactctggaaggacttcactcctggcatgttataggacagcagctagaatatgctgaaagcatctctgtcagaaagaggtcagctttaaaataagaacaccaggaaatgagctgggctttcttaagtcttaaaattcatattctctttctctgttttccctccttccctctctgtgtccctggccacaaaatgcacagtggcaaatcaatctctgtctgcatgtactcttgtaaaacattcttaaagatggatgccagatattttcttgaacatggctaaaagaaaccaataattagtgaattggtgctgatttttaaatttcacattttaattttatgtctaatattttattggtatttcacattagattaggagacaagagaataggaccttaggtattagtaaagctaatttactaatatcaaggggtagactagtagaaatcaataccagatttctttttttaaataaaatttttgatgtatccctttggctgttgcttttcctgataacctggataaaactaaacttgattctaaacagagttctgtccttgtctatatgaaacatcataaattgccagaaggaataatagtccgtattagccagtttatattccatgggttctttctcactaaatacaatgtggattgctttaggataatgtatattcttttaaagcatcttcctgcatattattatgtttattatcgagacggagtctcgctctgtcgcccagtctgtagtgcagtggtgcaatctcggctcactgtaacctctgcctctcaggttcaagtgattctcctgcctcaacctcctgagtagctgggactacagaagcatgccaccgcgcccgaataatttttgtatttttagtagagacagggtttcaccgtgttggccaggctggtctcgaactcaggtaataccacccaccccagcctcccaaagtgctgggattacaggcatgagcccctgtgcctggcccattttcctgcatattaaagtaatacttgctaattattgcaaatttgagaaatgcagaaatgaagaaaaagtcacccataatcctatcactagaaattaacattttaaaatgttttgttttagcttttaatgaagttgccaagaatattatgaatttttgatgttcttctatggatgagctacttgggcttagctcttttagaggccaaagtttattttcccgacaatcctcctcacatgcttgggccccactctggactcttaatgtagaaggtaacgttccccatcttctctttctattggcttgtatggaagttcttgtctgaattctgccatatggaaaatgttcacatacatttttaaaaggagaaattctctcctcggtcattactaaccttttggctggttttgctggaaaagttttcaggattcatctgccaatgttgtttccctagaaggccatcctggctacctcgctaagcatcttatttgttctgtaacaaaaaattcttcatgctaaatcactcgcaaatgccatgctgcttagcgcccttctgctaatcacccattcccaagtttgtcatcaaaatagcattagttattttccactcaacttcagccctcatcttcccaagccctccacttttcattctagaagcacaatctctcaatccttaatcacagaaatctccctgttcacttctcattatacacatacgcaaactgagactcagtgaaattaaccaatgcctcaaagctagtggatgccagaattaggattaaaactcatcttcagactccgaatccacatctgttatttgtttattctgccattatcctagtgtttttcttctcgatgctgctaaaatctaattcaccactcttcatagaaaacttttctttttctcctctctttttaattaagtaaaaaccgatgctgataacagaaagaaatgcatgattttctttggtaactcagtaccatttcatcattgtccatcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacaggtaaaataatagtcaataaaaatcaacccctagtcttattattattctcaagtcttctgggcatcccacttagcagttgcctgtctctccactttttcttccttcttcaaacatagtcatggtatgcagcccctctctaccactagacgtggtcaataactgtgtgtgtgggtgtgtgtgtgtgttttccccttagaaaatctatttgcacttttaaaggaatattcattttctaattcaaaagggggtaattgtgaaaagaactggctttacaacaatgtggtaagcttgtaggcatagttgagtagtgtgcctctatatggtgaaatactccttgaatgtctaatcccaaacaagtaattaaatatagtataaactacaaagtaaaagtcactaccgacaaaatatcaagggcatcaatatgcctcctgttttctgctttctgctgctactttctactccttgcaaggtccagtgatgtacccactaactgtggactctcaccgaacttttcactatagcacttacttgaatgtttaaatcttttctgggtattccatttagcttaaaaaaacatcagttatcattttggagttcatattcttgatagaagggatccaaacactttataggtaagcatcacaagataaaatcagcaagacaatttagctatttactggtacttgcaatttaaagcttaaaatcaaaattaaccaaaaccagaacagactttattgggtttaaactaaaaatgtgttttgctttctttcccttttttgtttcttgtttatgatggaagtttccccagctagactttatagaaccagagcaggtttgcaaaatgcaaataatgacactgtttaacaaaattgaaccactggaccaaacagtgagaaagtacttgctgagcaattcctgggttaattacaggattctgatgagctacatttaatgtgcccattgattgtagacgaaaatctgtaagtaagctttgaaaatttttttaaattttattatggatcatgtgtagttcagttagggctcaaaaaagcgaatcttcacccctatttcagcttttgacccagacataatcttatagggaaacgttgttttgaggatttttattagtttgtaaattttgtaggaagtctgtgcttttgttcagagaatcatgtaggtagagaggacctacgggatctagatttgcatttgcaatagagttacagcttttagcagcattatttagtcacttaacatttcaatttaaatatacaataagacaaattatatgtaacccacaaggttaatatggaaaacaaataaaataatttatataagagatttttttcacactttaagcattttcacatgtgctttcattattattatctaacttaatcgcattcttgcaactgagcaaacttagatttcttgattccaacaatctttctagtaagctaaagcttcctcagctgtaattcaaaaatatatatggggcattaatatgaatattataatattcattttggaaaataagagttttctgtgtgaatgaaaaagcaatgatttctgacacctatccatggatctccttttagagttttttttacatttatataactaaagcctttcaaaattgtagcagcagatacaattgactgctagaacatgagcaaatactttattaaatatttatgacaatttcttattgaattttaacatttatattaactttaatcatggtacaattaagtttaacttacatagaatactaacgcaaatggagaaatacgggaaagctttgcagggcatctcaagggtgggtctatgtataatgaataaatcctattcaataaaatatacagttttactttttgtattatttaggccaggaaactcttagaagattattatggattttcccctacatattaacttgctgtcttggtgtaatatttgttggtcctgaatacttttttttattgagttatctttgagtttgtagaatcatcaaaatcctcttaatagatttaattaaattgctttcacaaagttagacttcctgagatagagattcaaagtttggtgagactggtaatggaacagaagagaatccatggaaatacaatcctgggtcttcagaccccctaagaatgtcagctcttcaggcagtactgtctgtattcaacagtaaccatccgccacgggataggacagcattaagtatgtgtgcattccccgtgacagtgagcacagtgctggcacatagtgtttgcgtaataaatggttttggttgactcactgtctgtacttgagtttgtgccaatcaatcaaggtatcttacatttcttagtaaaaggcagcttacatatgttttagataaaaagatagggttcttaatgttgatctcaccatgacagtaagcaaaatgaatggtgtgtaggtgattcaagctcatgacctggacatcatgaggaagggcaagatgaatttatcagccacgttttagattcctgcaatatgttattccattcagccattccacaaacctttactgagtatccaatttttgtgactggcccacattaggcattggggataaaaagaggagtacgaattcacagcttagagaagggataggcatgtaaaccaaagattatgcacctctatgtgtgttaattgtaaatatgggctctgtgctgtgtgagcacagtgggtggggaaataaacagagacttggaaaggcatggcatgtttaagaagcatcaggttctatctgacttatgtttatggtgtgcacatgtaagtggtagagggttgatgggaggtgagtcaagaaagagagcttggagacaggagaaatgctaaatcatgtgggcataattttgcaagaaggagccaatgggcctttttgattatggactgctattatccaatttaacttttagtacaatcactaactctagaataaagcttgtattgtagtgaaggagagggggcagggaagcagatgtggagaagatattatctcctggactggcagagcctaaagtccctgcctgaataattagccaggtacccctccagcagcatactttaaagaagtgtctggccccctatctccagtctagatctgtcaaagctgaataaataaagaaaagttgctttaattacttttctgaaatttctccttcctgaaaacttgtctgtgggttagagaaaacaagttgaaattgcatgaaatgctttctctgagttcctctgccaagatcaatttcttgtagcacgatggaggtagtaaaatacgaattctgctagagaaaacatcatgagattgtaaaactgacctgattttcatgaaaagaaaatctatctaccataaattcagatctgagcacatatttcattttatttttatcaaccgtgagtaggtttggcaagccttatgacaaaatgatatctgggcatatatgttaagtttttaaaggaaattatcaaaaactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattggaggcaaatgaggtctaaaaagattggaggcattaataaaattaataacaccagttcctcgcccttctttgtgttaagcagataggagcagtgagaggttgaaggccaaggtgatagcaagggtttggtagcagcaattatgtcatatcctagggccagggcctaggaccacacaatgggatgagacagactggaagaggccaagactggaactcaacccgcccactggagtagtgcaggtagtaggatatcagggagtctgtacaaagccaccaaagatggaaggtccattccgaagaaacaaaacacagaacccagaaaatatggaaatctagattatacagaagccaggtaaaccactgggtgagatgggcaagaaagcatggagctgagtgatgtagaatggaggataaaacaggacagatggctgctcatagcatcatgtagcagagttctgtcattatctgttctccaaagggactgatcacaagaagaatgtgccttcatttaggatgaactgaagtcttgaaatcaacacagggaagcaaaaaccagttagaaagtcaaatatgactttcaggcagatttcaggaatctagtagtttactgcttttgtttctgagtatctggaagaacacatgtgatatgcagaaatttgatagtaaagtatctggtaaatgaaagactggacttttggaactggagaatagttcagagaccgatgatcaacaagcttattgggatgctgaggctcagaggagagctaggctcaggcttgtgaagttcctcctgcttaaggtcacggtggagtggggctgagaaaattggttgggatcagtccagacttgtggagaactggaggaaaggaatgaagctgagaaagaatttggagaaaaattgaaactttctacctgcttcctctcaaatctcttctgtatgactatatctttatgattatctataacttctattaattatttaagtaaatagtgtttgcaagggtccgaacatgggagaaagataataatatgggaggttaaggaatcttgtggggagaagataataaattcttatcttgatatatttaatccaagtcatgatgggaaatgtcttatagaatgtatattaacagcgtatttgtacataacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactggtaagagtgtaaaagagtaaagggaggcggggagaaagggagaccgagaggggtgagttacaggaaggctgagaaatgctagggtccttgaagcttagggtaggatgtctttcaacttgaaggaggaagtgctaatatttaaaaatcaggagactaacaactttatgggggtggggggaagggtcacagtttgggctgagaggaggctattaaaaataaaaccaaatagctgacttgtgttgtgatttgaggaaggacaaggaaaaattttcaagttgtaatgttggtggtggtacgctcaaagagttttaatacaaaagaggagttgaatgaaatgacacatggtaggggcagttgtagtgagtggtgactttccagagaagttgtcctgagaaaactcaagcatgcattaaaacttaagaagtgaattctcagtaaatacaaggctcatttcaccttgagaaatgagcctctgaccttgtgaggtcctcagttttatggaaggaacataatattagaccagtgggtcctgagatccagctggctacttgcatttcctgtgaagctttagaaacgaagattccttgtcgttatcatcaaatcagagcctctgcatgcgtagatgaaaggtgagcatggggaatctatagtgctgaaaagctcccctaatatatctaatgcaatgatccatcaattggtgttagggaaatattctactagacctgcacctactcccaggttaagaggcttaacagcaaatatcattaagggccttaaaaaataacccttttctttcattatctgtctcactccccacatttaaaccgctcatgaaatttacacttttccatgacgctttcttagattgatcaggtgtcatattcaggggatgaaagcaaaaggtagttctttgtggctcttgtggattcttcacactgtattttaagagagaaattttctatcaagtctactctcagtgcattgattagtggtaaaagtccatttattatctcacagaattactaagtctgtagcatattctgcagagggggtgttctttatggtagatcgatttgttctgtaacttgtataattttccattagaagatgtcatggaagtgctcctgttcatatcccacacatcagtggctgcaaatcaaatgaagcctgttacttgttactgtagaattggaccaggtttgtctgatactattccatgccaagccatttgccccagttcccatttgggggccagatgaaattattttgagtgcatttcgatagtgatatccctcctgataaatttagcatttactgagggatccactttctacgcatgcatgtaactgctattttccctgagctcagagatcgttggcagaagtgacagctggtgcctcgggatggagctataattttatggtgcagtgtctacggctggaaatgcaactagcaaaccacaaatgccaaacacatcataaaggaaaatgttccttaggaagtacttgccaatttctgagcaattaattagtccctaacatacacactgacttgtatgaataaaacagcctaggaaattaatttaattaagcagacagttacgataaaattaggtgctttccccctttagcaaaagatctctctttcatacccacttctggcttgcatcctcactctctggtaggtctgcttccattttccaaactcttataaggactctaaaggaaattcagtattcttagaatgagaggaaactgactggttattccaagtgaaactgcttgtctcccagacattttcctgttgaaattttccccagcttgctacaccttttctccactttctatggaaccaagagagtggtagtatctgtgaggttcaagataggatctattgacaaagctccagagtggtagtatctgtgaggttcaagacaggatctattgacaaagctccagggaagaatgactgtccagaaatgctccttgggaatagcttttgtggaaagaaagcagtgcctccaccccacatctttagttctggcagctccctatagcgacaaagtgaatatagatcagaaggacaggagtgcatatcagaatggaccagatgaggaacagcagaggaacataagattcagggcagctccaaacttctagaaggacttgccaactctggtcagttgaaaaagtcattatatgaatatcttatttttctaaaatgaatgtgtgttagattaaatgaaagatataggaagggaacatgtgaacattggtaaaatatagggattagaagtaaaggagggattagtgttttggaagataacggtagcaaaaaacctcaaaacaattgtgtttgaaatcacatacacactggcctaattgactggacattcttacatggaatgctactaaccagagttcttgtttgcatttcccaagcctagaaagatgatatataattatcaccattatatatttatttagtgtgctctctgagatgcccaaaacacttggtgacatatttaattaattcatatcacttctataaaatatttcaggtatttaatttcagttgctataagaaaaatatttattgatttcttttttaaaaaagactgcagttggtaaaactgacccagagtataaatacagaatgaaacctgcagtgagaaatgaattccacagtaatacagataacaaggagaataaaacccaaagtcagagaccttgatatttgattatcttcagttgtttggaatgcatggtttgagcatgctcatgagaacactggcatgatactgggtaggttccctctttaaggcactaactactctggagagtgactccaaaatgtggtttcccactcctcattactatgacaaatttcacattaactcaattgtcagaccctttccctgctgatacagggttgaagggttggcttggtgatcaattctttgagctttcagagagattttgcagcttaatggaaagctaatttaaggaaaaaaaaaaaaagaagttgaactaggatttgctctagggaccataacatgaatgttctattgtaagcttcttgatggaaggcattatattttaaaatcctatagtaatacaattaataaatacagaaaatgccagctgatataatagaaaattgttcaagactccaaaaattaatctgatcccatttcaaagtgaagctaaaaagatgtccatgtttttagttgtggaatttagagtatgtgatggggcctacttggaatcctagtagacagaggaattaaataataaaatttgcattactcagatctatcatagtggtggaaatggacactgctcaccttgtgagccttgaatgaatcaatgttggatcactggcttgcaatggatgaagcttggcaggcgtggtcttcctgaagtggcactcctctagaccaacacatgatactcttattccatcataatcatactacagagaatagacccccataaggaccataaatattgtttgtctgtactgtactgcaggtgatcaaaactctggcaaccaataggatttattttctagaggacagatactactccaaaacaatactagatcaaaaaggaaggctttaaaaattacacagaagtgtttgtggcaaagatccctctttgtatgtgtaggactataggtattaagattcggaagcaagcagaacaagttctgctatactatttgccaggaatctatgtcctcaaaattcctctcctcatttagaaaaacacaattacaaaaactcagccatagagtttgcagtttgacatgttgctgattctacatgataattgatcacttcaaaactgacaggacttacattaggctcttgttcttagttttagttttaacaggggaaccaggaaagaaagaaagattgctcatcagtggccatatttggcaaaggcaagactctcttcccccaattcattcatcctgatagagattgacacagaccagatgttattccaatgttaaaattacattgttttcataacaaagtcagcttatattactcttcaagagatcacactaatgctcctttgtatactgttatgaggagggtgagttagatctttccagaggacttgccaagcacaaactataagaagagttaagattttctcaaggcattcactagctggcttacaatctacatatctatgtgtctctgcagcacatagaggatttcaagtcattgatatatatatatatatatttatatatatatataaatatatatatatttttttatatatatatataaatatatatatatatatatatatatatataacctcttttagtaatttctgatacttagaagaaattacaggtacttgttcttcaggtaggttgagagctagcgatttcattggctagagcttttttgttgcttattttctttgtcctttcctctcaggtcatggtgaccttaaattatgattccaatgcttaagagttttatgtgtgctatttttcccatgtaacatctggaacttggaaggtaaaaattccaaatcaagggccagaatccatatgggctcagcacatgtaaaccataattttggaagcttagtccctcttagcccccttatcattgctgcattcccacttactatatcacctctgtggccttgatggcaagtttgggaactgagaactcctgaaaatgccaacaagcagtcatcttcaggggattctaatagtaaaaggccaaatgaagacattccttgctgaccaagtcaccataactcttaaactattgccgtgagccagaagaaggaatttttttcttttagctttagagactttgtccttaattgacttcatgcttcttattactcacaatattcatttttatatagtcggtttatattgtagaaaacaacccacttaaatatttatatatgataaaactggtgagtatgagtgagattataaaacaagttaatatatttaatattacaaagaatgctaacatttctttatttccacacaacactctcttctcttcttttattctcttctctttttgcctttaagcaaaataaaaaagactcaaagtaagggcgagaattataatgccaaaatactcaggaatatcattcaaatcttgaacggagacccccactccctcaaaaaaaaaagaaaagaaaaaagttatccataaataatgtacttctccttcaagattactaggttatgtaagataaatgccaccattttctcctcatgctacttaatctaagaagtcttatgattttctgtttttcaatttcttatgttttcaatttcttgtgacttgtcaaaggtatgactggttgggttctaatcaatatttttctactcattcaacactatttggctctaaaaccaaaacaaaattcaatttacaaatatattatttttgtggtaaattttagattgtctattactccaaaccagagattttaatgctaatgtttgttttgaggagaaatgagaattaagcttgatcttgatgatcaaccacagcaaaattatctccagttaggaaacaccagtctaaattgaaggtatagtatgtctccactttccctgaatgactacatggtattttactaagctttgcctttgtaagtacacacagaagggttcttgactattctggcttgaagaacttatgctgaaatgagtcatgtaaaccatggcagagagtcacaaaactggaaacatggaaggctgtatggtcatagaaacaccttaccagtagagtaccctgaagaagacttcttgttagcatttgcatgagttcttggtccccaaacttaccatcaaggccacagaggtaataaagtcaatgggaaagcagcaatgataagggggtcaggaggtcataacacaaactattggaggagttaagattttctcagagcattctctagctggcttacaacctacatatctatgtgcctctttgcagcacatggaggatttcaacactgaacatttgaacattagatatataaaagcatgtgtatatgcatgcatgctggtgtgtgtacacatgctggtgtgtgtacacgtggaggtgtgtgcaccctagaccttttttgctatactatccttagaggatgtgtttccaaagattagatcagcaccatggagcaaagtgcaaggaatgaaaattaatccagtgttaacagctttatacagtaagaagagtaggtcaaaatgtttaaaattctcattgggatctatgaacaattttttatgctatcctctccacctcaaatgtcctacttccacatccttgcacgtccaaatcttgctcaatccttttagatatagctgttaggacaccccttcacaaagctatctgtgatttatcactcagaattacctcttttctgaatttaccatcagatttttttctgtaaattcacatggtatagatcacttcctgacttgtatggtgattatgtttctacctgattgttaatagtgaactataaacatcttcagaacaaaatccctgtctgcttcaactttgcatttctgaatagaaggggaaacaatcaagaaatatttactgaatcaaaatatataatggtggccatatattttatcctttttttctaagctaatagcatttctcccactcttaaaaggcatatgcagaaatcaccaagggtgatgtgacagcataacattagcaaagtttaaaagtacacaagagctaaactgtggatacccacacaaacagggagagacctacttcctggtgtcaatgaaattacagctctaaagagccaatatgtcatttaatttaaaagtcactgttcatgaattgcaattaccctctggcctgcaagcatgtgttcatagctaagaaattttctctatgcccaggtagaatatattgctggcttttccaggggaacctaatgccaaatagaatggcacctacataaccaacttgaggcatgctttaaaaagtgtccctgtgataagccacaagaaatgacagactatgttgaggaactcagtgactctacagccatgctaggcttggagcccactcagacaacaacatgggattgttgtttttaagccaattgctcacagtcgataaaacaaaaggattaaacttttgacagactttccctattctcaccaactggctaatgctagtgctgctttgctcaggcctccttaagcatgtttacttgcaattccttccaaatgtcacttactagaaactgcattcctgattctggaggtaataatcctggagacacagctttcatcagctaatgggtagtgactcagagtatatccagagacaaacaaattaaagagcatggaagattggagcaaacagctaaagaactttgttgtgatatatttagaaagcaggcattctgttccccaataacattgtgctaatattggtgctttccatttactggatttgattgccagcaaaacctaaacagaaatgttttacatccataaactactcccaaatcattggtctgaaaaaatgccattctgtaatatgcctactgctaacacttccattagttgctcaagagaaatgcaagaatagcttagaggagtcttagccaaaaatatataattctgacatatggagaaaaccaatgcaataatttacaaaagattaactgttaaagtgctgctaaaggttggggggattactttaatcaaatgcctgcattctaatatggtgagggttattttattttgagacagggtcttgttttgtcacccatgctagagtgcagtgacatgaccatggctcactgcagcctcaaccttctgggctcaaatgatcctctacctcatcctctggagtagctgggactacatgcatgaactaccacacctggctaattttttaattaaaaattttttttttgtagagatgaggtttcactatgttactcaagctggtctcaaactcttgggctcaagtgatcctctagccttggcctcccaaagtgctgggattataggtgtgagccaccgtgcccagctggtgaaggttgaaaacaattttacaaaccacatttaagtgaggaagaaaaacatgtagaaagatccctgtgttctttagatgacatttgaaaaatgcacacatgcttttaaaagccatttgttgcacttactcttcaggaggtatgcttaaatgtctgttcagaaaacatcttaaatttgggatacattgttctgtcttttaagattgctttagactgctacttactttaaaagaattgtgagattactctaggtgtatgtttataaaaaattcaaagttcagaaaattcctgtaagccccttaagagcattttaattgtagcatttttcctatgatcctttaagaaaatccgctacgggttttcagattatgtttccaccccagttgagagtaaccacaatgacaactatgtactgcaatttgcagcagaaatgactacacatttctgcccttagctgaaagaaaaacaaccatatggaccttgttcttagccagcgctccattagctaattaaatttacaaagcccaaccagtaagagaacatggattagccccattctaatgactctatccctttggcggagctaatgttgtcttgtttcagagcagactagagaaacttgacttactttgaataggtcagacaggttagtccaacagaaatacaatgcaagtcacatatatatgcaaaaagataaaggtgaaaatttaataataacttttatttactcaatatatccaacatatcataatcttaacatataattaatataaattttaagatttttatattctttttttcatactaaatctttgaaatctggtatttatggttactgcacttcttaatgtgggttagccacatgtcagtgatttaatagctacgtatgactagtggctaccatattgaatggtacaggattgagtggtgagatgtgccattccatcttctttccattgttcacactcataatctatttcaggagtacagtgcttcacttttcatacgtgcatatcagctgggcatatagtcattttaaattctgaattaacctgaagatgaaagaacagtggccaacttatttccttttaagaaaaactgtctctagttaaaaatacaacatgcataagtatgtgaggtaatgtataattattaatagctcaatttagcctttccataaggtatacctatttgaaaacatgttgtacatcataaatatatagttttcatcaatttaaaaataaataaaaacatcgtttataagtctaaaaagtgctaggggcaaaataaggccctctctctagcctattgacccattttgaagtaaatgattacagctgtggaatgcttcaaggaacttaaggtatgatgtgacagcttgagtttgaaagtcttctctcgttcttttttatgactgcatagtattccatggtgtatatgtaccacattttctttatccagtctatcactgactttgcagggacatggatggagctggaggccattatccatagcggactaacaaaggaacagaaaaccaaacaccgcaggttctcacttacaagagggagctaattgatgagaacacatggacacacagaggggaacaacacacactggggcctttcaaatggtggaaggtgggaggagagagaggatgaggaaaaataactaatgggtactaggcttaataactggatgatgagataatctgtacaataaatctccatgacacaagtttacctatgtagcaaacctgcgcttgtacatctgaacttagaagttgaaaaaatatcttgaaaaaaaaaaaaaaaagaaaaagtcttctcctaaatttaggcaacattctatttcagttgagctgtgtataactggcccatgggtgcagggatcacgttttcctacctagaaagggaaacatgatcttacaaaggaattatttgtccttgtatgatttggtgacacaaaaattctcattggggcatgaaaataaaatatatttaatgaaaagatttgattggaaaaagtaaagttacagaaaactaggttgttttcagagaattcaacaaacttagggtgaataaacactaaagttctacttcacaattataattgaatcaacaaatggatagaagctatgaagaaccaattaggttgtgtccttacctaatttctggaatgctagtgtgaataagcctgtgccatgacaaatatcagaactgtggacaattattgaattttagtcttaaaatcagggtactttcctcaacttctagaatcaaaagatgtcacttcatcatcttggaacatttattttaatctgtcctgaatgtaattatttgatcaagctattgtcacaaaatcctattaactcaaagagtgattgcattattcactccttactcatttcttgatttcagtgcttattaaatgaaagttttcaggcagccaaaatgaaggataaccttaaggattcttccttctttttaattttaggaattgtatactgtagtttatcataacaacatatctaggctgcagaaattcagggaaggcctgaaggttttaataaaaattaaaaacaagacccatcaaatgatccaaacacttcctttgcttatcttaaaacacaagaatcagaaccagcagaatgagctttaggcctgggaacaaaatgtcagagataaaattggtatactattttcacccctacgatctacatggttgagggggtttgaaggaagtgaagaatcagatatgtttctgaaccaggactcaaaaacaagttttataattgcaatatcttcttaagagctcggcgaaaatggttttcattttcttcttagattcttttaagaggtgccacattgtaaatgatcataatggcacaaaatgtgaattcatgtggaaaaaacaggcattaatgattctgaatacagaaaagctggattctgaagggaagaagtcttaactaatttacttcaaagtattttccttatgatgtatgaaaaagaatgataagataaaaatctatttaattaagaccaaaaacatctctgtaggtttaaaataaaatttgtacgtggtaagaaagcattgtgtcatggttacttatgggcattttttcttggttagtgatacataaaataatggtatatacaatcaatgctgtcttaggttcaattaaagatgatgtgactcctacatctactttatttcctagggcctttttttccaagtgatatgttccatccactgggagcaattttcagctggccagacaccttcccattatccccgaagcagtgtgattttatccttttacatgaacaatgcccttagggagaatgacaaagatactggctttctgaatggcaatatattggatggtcttatctataactttctcatttttcctatacaaatgttgggttctatttcttgaataagttctacagaactcatgattacagtttcataaaaaaaaagtgatccaaggtataataaaatatttttttaaccttgggttttcaatataactactcgaaatgactttaaatgctacacaaaatatatttttatattaaacaaatccacattaagaagatgaaaataatataaaatgattgcttaaaaaatatgggcataatgtccccatattacagattctggctccaagtttctaagtcatataatgggaatcatgtcttctggaatatttggtttaacggtgtgtagtgccagggctagaaaatgtgttaagttggtgaaacaactaccctttccctttttttagtatttctagagtgttaccctttggggctcccaccagtttggaacctgttttacttagagtgttttctaaaataaggcaccaaaatatgtgctagggctgcacatattcaaagtatgctgcagctctgggaagttgggcagattgaagtaaccttagggtccgtgaaccagacctccttcacagccacagcactgcaagagcttcctctcttcttgtaaaccaagctatcaaagataactgttacatacatgtatattcacctctgacacctacagccaaggaatgagatgagaacatgaaggaagaagttaggcgcaggaaaaataaagggtgttagtagtgtccagcttgtagaaagaactcaaattatgcctcagtccagtgagcactgaagaaaattcctcaagtttctctctgggcctcttgctttctagttccagctctctttccatagtcaaggttccaaaggcccacctcctctcctcatcaaatgctttttgcaaaaacagatctaaaatctcagatatacacatgacagataactgcttgaatttctcttaggaatcactaggtacttctaaatcactggagagtcaatctgaagtcagatgcatactccctgaatattagtctttcaggtatcactgggcaggaaggggagggaatggagagagattctgggccatgtgtgtaagagggagggcagcttgtctgagaatccaacaggaactcccttttttctaggcatcgtccagagattttggttacaatacttggaggtaaaattatatagagggtaatggttttctctttggcacatcaatcaactctgctctatgatcctataaacaggaaagagttgccaaatttgggcaccagaggaatccttggggctctcagcagtctcctcttcttaccacaatgcaaagcaaacaagagttgaaatgagaaaccagagggcaattagtgtcctttttttccttctcctctcatgtatccatttaggctttaatgcactttaaagaattcagaacactgagcaccaataaatgcttacttttcaagggaaaagaatccaagaatgtcaaatttggaggcctttgagatggtttagtccagatgtcagacatcattcatttagtaattatttacaaattcagtaattatttacaaataccaattatatgccagacactgttctgagaactagctacagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaaggtaggcctttctgagaatgtgacatttgagaaaagagtgtgaggaaatgagcaagttagccatctggattatttgaaggggaggcaggggcaaagacagtccagacagtacacatatgtgctaagacaggagcgcctcacctgtgtaaggtttaaggacatttctatggctggagaaaaatgatcctggaggaaaggtgagagttaagagtagagtgaggggaagtggttggtggggccagatcacatgggccatgtagactcttgaaaggacttctgagggaaatagggagccactggaggattttgagcagagaagggatataacttgacttatactttacaggatcactctagctactctgtggagaacagattgtagagataagggtgctaccagggaggctactgtggttcccggcaaaggatgatggtgcctcaggacaggatagtaacacttaggaagacagagtatagagtgatagacgctggcccatgggtagatgtggtcatgggagtctgcggagagtctcttctgattgcttctattttctcagggagacaggaagcaaagcaagatcatcagctgacagtaagacacaggaggggaggcactggacatctgaatggggagaagaaggcttgactgaagtagctaagacagtggcagaggaaatggactagggaaatacagattgacttatgacatcatcaagtgcctactacttaatattgcctctgtatccacagctctcaaatctccaggcagcctctattgattgatctgagttggcagatgagttggcaggtgagagaatgtatatttgctagttctaatctaatctaattctgctttagtaaactgaggcctagacagtgccttttaaacatctatctatctttggggagggtttaaattatgaattaccaatcagctatggctccagtaaggaaaacatatacagtacctatttaaatatcatgtagcaagagggcctgacaactaatgctcttgggaattgatgctataagagaagggtatgaagagctgcagatgagtgcctgaaacaagagctttattaacacagcaggaagaagatacctgctggctggattttcactgaactcatagctctttgcatttgggctcaaggtcttaatcttctacaagtagtgacttcagtttctaaaggtttcaaggggatcatccagtgcttgtcttttgaatagactggcatgacttttaaacaggacccaaccaaatcacatttgatttcaagaaattgaagggataattaagaaagtgttagtcactactgaatgtagtgtatatgctttcttcggaattttaaggggggagaaaggcccattaagtcatcttaaaagggctcttgctgtaaaatgaaaggtggagaaggggtaaatctgaaatgcaaatgaatttcctgtttcaccagaaattcagtattatctaatgaatgctgagtaattgaagcacttattgtcatttctgcacccacactgggaaatggtttctgacctttagattccctactcttctgaattgcttctcatcagctctctctttattctcactcccactcagtttacttcttggaaggcctgttgacctttacctttttgtcatgtacagaatacagaatggttatgtatataaggtatcattaacatcataaggctacatgcaattataaaagaagatgagggataacttacacaggacatagtccttgctagattttatcaagaccctcattttctagtggtatatcacctttggaaaagccaggccattctgaagtaggtctttgtctttccagtctagaaataattgttatgtcaagttcagtgataaaatgaatggctgccattggctgaggacccactgtggggcatggagctagtgggcatctctccagtcatctcacaacaaccttgctcatctcttccttttaattattttactgtgcatactcatgagatctgaaactcatgtacgttggcacctttaacataactacactagttcttcctataaagttttctaatgatagtggaacttttaaattcagtttagtttttgacattttatttgtctttttgagaagccagtaggacttcaaaatgttgggcttttccaatagacagctaaaaatgtagacctgaagtttacaaaaatgattagagctaaaggtatagatgggaaagtcatcaatgctgaagtgatagtcattatgtggaaatttagcaaaggaaagatacttggaggcatgctaagtggttgaaaaaggcatcttggaagattttcatgtttaggtggtgggaagagaaacacaagccagaaaagaatccctcagggacaatgagaaaagcagagcagcagaccctgtgaagttatggaagtgaaatgaatggatcctgaaggtatttcaaatggtttggactatcagggccaaaaaagaacttctggaaatctggacttggacaaaatcagtcatccttaaggggctggattcagcaaagaggtagatgaaaaacccaggttctagggtcctcttttatttcatgggagtgatacagaatccggatcactttagaaataaagcaaaataatttttctgaagatgtgaacagtgaagtgatgtgtctgtcacacactaaaaacataaaagatgatgcatgaataaaatagggaacagcatcactagttaatgcccacataatatcataattctatacctaatccaaatttgatgaacaaaatatatttagagcataaataaaacattttcaattgttcataatatattctccaatgcactgtatttgtcttggtttgaaaaatccataaagattttatgtaatttaaataagcaatgaagagaggaagaggaggaaaaggatttcaatatggcccagagagagagacagagaaagagacataaatcccagttaatctaagggaagacttttaagtcatagttcctcattctggcgacttatctgttacttatttccaggtgctaaacagaagagatgcaatatcttttttttttttttttttcctgagacaagtctcgctttgtcgacaggctggaatgcagtggtgcgatcttggctcactgcaacctctgcctcccgggttcaagcgattctcctgcctcagcctcccatgtagctgggactacaggtgtatgccaccatacccagctaatttttgtatttttagtagagacggggcttcgccatgttggccaggatggtctgtatctcctgaccttgcaacgtgtctgtgtggtcctcccaaactcctgggattacagatgtgagccaccatgcctggccgagatgcaatatcttgaaggcatcagggatcctgttgtttctcttcagatctataaatctgctgccttctgaaggcattaggagcacctcaaagaaagcaagatggagcattaacaagtgaagactcttcttcttttcttttctttcttcttgcttgctcttttctctttctgcatcaacaatttcaaattcttgggcagagtattgcttgaactcagagttcctgtttgtgcaacagtgctgccttctgctatcagccacatgtagacttagttgaggagtcctatgtgtagattcataaatttagggcaacaaagcatgtgtgtgtaggggggttgggcaagagagctaaggctaagtcagggccagaagttgcctgtaagtagctctgtaaagcacccatgtctgatttgtggaggtgacatcatcattagctgcagatcaatactgaccagaatttaaggtactatgccatagctttaagtcttcataatttaaagatgactaagttgtctcttctctgtaggtctctactttgagttagatgacttcagaaatgatcacacatttcatgtcaaatttccaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggtgaatgtcatgtgtgacagttgctcatggatgaatgaataaccgaaaggggcaccagcagtagcaaagtactaagatactgaggaaacttggggtacttaaccaaagtcccttcatttcttcacaattatgcttaacaccaaccagcccagcatctgacaaacaatcccaaggacattttttcccccgtcatctcaaatattttttcaaaagtgatcattttactctgtgttttggtagaaggggcgaagtccactttgcagctggtacaacagaaactagagctgcatcaattctctcacactgccaagcctttcttctggcagaagcgctggggatattacactggggataattcatcaagcttgctttgggtgttccaaatttgcaagctgtggctaatttccagagacttcagggcaataatctctgctttcctaaaagaaaaacagtaaccacaccacctttcaattaaatgggtcatggaaaatgaatagccacagatgatcacagatattcagaaatcctcagaaaacctaagtgtgtagccagtggtagaaatgatgactgtgtggctgaagaagtcccatttgatgagggctaggaatctggcatctgcgtctgcctccacatttgtttctccccatacattttccatgtatgaatatgcacacacatgcacatgtgaagcctcacatgttcaagaccaaaacatattgctggatattaacaaaaggaattatagcctcttcagctatgaatcaggtgaagttttcctcacagtctctggagtctgctttgcccacagaaaagcagacttccttcccaggtcagtaagccatgctggagagttgccctcaaccccgcaactctccccaaatatatctgctgtcttttatgctttccaggccccgtgttcagaagttgtttagcagatcatttctttgtacactatctttttttttttttttcctcttttctgagatggagtcttacactgtctcctgggctggagtgcaatggcgcaatcttggctcactgcaacctccgcctcctaggttcaagtattctcctgcctccgcctcccgagtagctgggattacaggtgcccaacaccacacctggctaattttttttttttgtatttttagtagacacggggtttcgccaggctggtctcgaactcctgacttcctgatccgcctgccttggcctcccaaagtgctgggattacaggcgtgagccactgcatccggcctgtttgtttgtatattatcttaactcatataatggatcagtatttttttgagaatttccaggccaacattcagaagaataacatatggtaggcattttaagcaattaatggataaaggaagggatatttgagggctgtctcatcccaaactaccttagttttttactctggattttcctttctatggatatgtcaatgattttaccggatcaattctcatggagcagtggactagtttgggatggtccctactttcaatttcaggaacactgtaaagtcaaacagaaccttatgagttttatatttgctagttctttttgtgctatgtatttattatatgtgtaatttaatagtttcaattcttttctctgctaaagtatttatgagttgtagcacagagaaagagctcaatatatgctaattattattattaatattattatctttagagataggatcttactctgtctcaggctggggtgaagtggtgtgttcatggctcactgcaaccttgaactcctggactcaagctatcttcctgcttcagctttcctagtagccgggtctaaaggtacacactgctatgcccaactaattttttaaaaaatgttatgtagaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgtgccactgcagtccgcagtccggcctgggcgacaaagcgagactccgtctcaaaaaaaaaaaaaaaaaaaaaaaaaaaagttatgtaaagacaaggtcttgctttgttgcccaggctggtcttgaactcctggcttcaagcaatcctcctgtatcaatgtagtgttggcattacaggtctgagccactgtgcttggcctatgttagctactattattattattaccttataattgctaaagccatctacctgaaaatctattccaatcattccatagttctcagctccaaaaccagtggagatttgttttttcataatcctaccaaactcctctgcactggtgtcatatctgacaaaatacccagaattaattgccaatgggtgatcatgggttgacatataagccttcccagtgtatgcttttttttttttacaattttttaaaaattttactttaaactctgggatacatgtgcagaacgtgcaagtttgttacataggtatacgtgtgccatggtggtttgctgcacctgttgacccatcctctaagtttcctcccctcaacacccacccaccgacaggccctggtgtgtggtgttccccctccctgtgtccatgtgttctcaatgttcaactcccccttatgagtgagaacatgtggtgtttggttttctgttcctgagttagtttgctgaagatgatggcttccagcttcatccatgtccttgcaaaggacatgatctcattcttttcatggttgcagagtattccatggtgtatatgtaccacattttctttatctagtctatcattgatgggcatttgtattggctccatgactgctattggaaatagtacttcaataaacatacatgtgcatgtgtctttatagtagaatgatttatattcctttgagtgtataccctgtaatgggattgcttgatcaaatggtatttctgattctagatccttgaggaatcgccacactgtcttccacaatggctgaactaatttaaattcccatcaacagtgtaaatgcattcctatttctccattgtgtcgccagtctctattgtttcttgactttttaataattgccactctgaatggcatgagatggaatctcactgtggttttgatttgcatttctctaatgaccagtgatgttgggcttcttttcatatttttgttggctgcatgaatgtcttctttaggaagtgtctgttcagatccttcgcccactttttgatggggttatttttttcttgtaaatttgtttacaatctttgtagattctggatattagatctttgtcagatggatggatcgcaaaaattttctcccattctgtaggttgcctgttcactctgaggatagtttcttttgctatgccgaagctttttagtttaattggatcccatttctcaattttgacttttgttgccattgcttttggtgttttcgtcatgaagtctttgcccatgcctagatattgcctaggttttcttttagggtttttatggtttggggttttacattaaagtcttgaatccatcttgagttgatttttgtataaggtgtaaggaagtggtccagtttcagttttctgcatatggctaaccagtttttctaccaccatttattgaataggatatcatttccccattgcttgtttctgtcaggtttgtcaaagatctgatggttgtagatgtgtggtgttatttctgaggtctctgttttgttccattggtttatatatctgttttggtaccagtaccatgctgttttgattactgtaggcttgtagtataatttgaagtcaggtgcatgttatttcttgacctgaatctttcctttgggcttcagtttttattaggcttttcctttgtcctgtatagtttcttggatgcttctcttctctacactcaaggttttctttctgttgttgttgtgtaggcaacacaatagatgtcatcttttgggaggcttcctaatgctgcttttggtgttcttgtgagctcagaggattcctactttagagtgaactgtaatgtcaacctctaccctagacaatgagtaggaaccatattcaatagaataagaaggtgaggctttgctaaaattatcccatctgtcagtctgtgaaaccagtagtttgaagattgtaatcacaacattgacacacataatgttaatttcaagcagttacataacttaattgataagtcaatctaaatcatacctgcatggcaacagaactagggttagaaagtgaaaaatattgttaagtaaccatatacttctcttagatttgatctggcagcagacatttctgtattctgagataaaatagctgtggtaaacagattgtgtgaaggcatgcatttgcatccaggcctacaggaccaatattaagagaaagggaacaattaatttgtctcagtggggtagtaaagagacacagccttcagagtactatgggaggttatatttcaacttcttacagttagtttgtaaatctaactgtaagactggcattgttattaatgaaagtttcagctaagaatgaattagatctaagttacactttatcagtatttattcttcctgctacctattaagggcacctgaactgctaggcttacataaaaatgtcccatttcctgttgctagctgtgctttcctttgataaactcattacaaattgcatgtaattactgtattgtgaagaagggagtggcaataaattaggcacagaatttttgaataaaactaggcagctagaaagactgtttctaaataacaaaaaatttgatatgaccaagtaggttaaaattaccattacatatttgattggtacaaaattaattgtggtttttacaattactttttaacattttgccgctacttttactattttgccattacttttaatatggcccatttttaatggcaaaatctgcaattaattttgcaccaacctaatattatcgtatatggaattttctgtatataaagcaaagggaaaaaaaaggaggcatatagaccttagcttatgtactttatgattataaatgattacatttatctagtgaccataatgctttatgaaagatgaaaacattcttctgggggaaaaaaaaaaaactaattaacatccttgcttgcagagattggtagacctgtttcttctattttagatttcagcaggacacctctatcgttggatgaaaaatgctgacttgcatgttctgggaatctgggctcaccccgaggctaatagcacagtgccctggctgtgtgcccaacgtttgtggcagggagttacccctgagtgctttttttaacttacactaaagttttgacttagaaagcaatattagctagtgcttcacaggaaactgggctttccctctgtaacactcaaagtcaaatcctatttcttggtctgatataatctccataatcataaagatctttgttggagaagttaagcagggaagactacatgtaggattctcctaatcttggggaacccaagttttgtgcccctttcaattgggatgctggagcggagttgggtcatggagattaatctttagaggtgtgtgttcatagaggagaaaccattgagaacaaggaaaaaggaaaagtggagaagcacagctcttgtttgaccttggaggctttttacatggaattaaaattcagaaactggctgaggttacaaggagtaattgtggcaattgcctcatccctactgtcagcacatggcaaagtttgctatggacagaattgcagggagttctttcaaaacagttcaaaatattgtcaagattttcttcaatttctcatcaacctttaagagctcattgaagacattagatattttgtgcccaactcaatgttgcagagaatttcagggcaagagaaatagaaatgaagttgaaatatacccatgtagtttccttcagcgatactatctggtatataagaaaacttacaaacattttttaagaggcctcaggcattacaattataagtttttttcttctcttcagacttttattctaataagttgttagccaatcaaacaagcaaaggtgttttaaaatacttcagtttatagcaataatgatttttaagtttgagaaatagaaaagaatcaaatcagtatcttaattagcaaaacctagttgatgagagagatgtgctttgtttgctatgcatgagattgcttgaaaaatgtgatttagctccaacagagcctccctactataggattttttttttttttttttttttttttttagaaaatcaatacatctttctgtcaaaatttggttagggcaaaatttgactaaaattgtgccaaataaataagatttttttcttatctgagattgatacatctctatttcttatgtataattttttatctcaggccaatgagcccaaagtttcttggctcttgttatatctttgaacctgtgacctttcaactggctagcaatgggcatgaaaaggagaataattgttgctgaaacaaaataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagctattaatttctgctaactcctaacctggtcaatgaattataagaatgtgcagttttatgtctattttagggcatggatgtgggggtggtgaaaagtcttcttggcttggagctctctctatttgtctcgctctttctagttcttttttgttcatccttttcctgacaggctgcttgatgcttacagaatgatgcaagattgtaacagattcagactagatgaggaagagaaagagcttagtaaaagcccacttcttaatagttgaatttttttttcttcaaaaaaaaagtcctatcaaccaaaaaaaagctcaggaccagacagattcatagccaaattctgccagaggtacaaagaggagctggtaccatcacttctgaaactcttccaaacaacagaaaaagagggacttctccctaactcattttatgaggccagcatcatcctgataccaaaacctggcagagacacaacaacaacaaaaaagaaaatttcaggccaatatccctgatgaacatcgatgtgaaaatcctcaataaaatactggcaacctgaatccagcagcacatcaaaaaccttatccaccatgatcaagtgagcttcatccctgggatgcaagggtggttcaacatatgcaaatcaataaacataatacaacacataaacagaaccaatggcaaaaaccacatgattatctcaatagatgcagaaaaggccttcagtaaaattcaacaccccttcatgctaaaacctctcaataaactaggtattgatagaacgtatttcaaaataataagagctatctatgacaaacccacagccactatcatactgaatgggcaaaacctggaagcattccctttgaaaactggcacaagacaaggatgccctctctcaccactcctattcaacatagtattggaagttctggccagggcagtcaggcaagagaaagaaataaagggtatttgaataggaagagaggaagtcaatttgtctctgtttgcagatgacatgattgtatatttagaaaaccccaacgtttcatctccttaagctgataagcaacttcagcaaagtctctggatacaaaatcaatgtgcaaaaatcacaagtcttcctatacagcaataatagacaatcagagagccaaatcatgagtgaactcccattcacaattgctacaaagagaataaaatacctagaaatacagcttacaagggatgtgaaggacctcttcaaggagaactccactgctcaaggaaataagagaggacacaaacaaatggaaaagcattccatgctcatggataggaagaatcaatatcatttaaatggccatactgcccaaagtaatttatagattcaatgctatccccatcaagctaccattgactttcatcacagaattagaaaaagctactgtaaatttcatatggaactaaaaaagagcctgtgtagccaagacaatcctaagcagaaagaacaaagctggaggcatcacactacctgatttcaaactatagtacaaggctacagtaacaaaaacagcatggtactggtaccaaattagatatatatatatataccagtggaacagaacagaggcctcagaaataataccacatatctacaaccatctgatctttgacaaacctgaccaaaacaagcaatggggaaacgactccctacttaataaatggtgttgggaaaactggctagccatacgcagaaaactgaaactggaccacttccttataccttatacaaaaattaactcaagatggattaaagacttcagcataagacctaaaaccataaaaaccctagaagaaaacctaggcaataccattcaggacataggcatgggcaaagacttcatgactaaaacactaaaagcaatggcaacaaaagccaaaattgacaaatgggatctgattaaactgaaaagcttctgcacagcaaaagaaactatcagagtgaacaggcaacctagagaatgggaaaaataactgcaatctatccatctgacaaagggctaatatccagaatctacaaagaactttaacaaatttacaagaaaaaaacagccccatcaaaaagtgggcaaaggatatgaacagacacctcttaaagaaaacatttatgtggccaataaacatatgaaaaaaagctcatcatcacttgtcattagagaaatgcaaatcaaagccacaatgagataccatctcatgccagttagaatggtgatcattaaaaagtcagggaacaacagatgctagagaggatgtgaagaaataggaacccttttacacttttgttgggagtataaattagttcaaccattgtggaaaaaagtgtggcgattcctcaaggatctagaactagaaatgtcatttgacctagcaatcccattactggttatatatccaaaggattataaatcatgctactagaaagacacatgtacatgtatgtttattgcagcagtattcacaacagcagagttggaacgaacccaaatgcccatcaatgatagactggataaagaaaatgtggcacatatacaccatggaatactatgcagccataaaaaaggatgagttcatgttctttgcagggacatggatgaagttggaaaccaccattctcagcaaactaacacaggaacagaaaaccaaacaccacatgttctcactcataagtgggagttgaacaatgagaacacatggacacagggaggggaacatcacacaccagggcctgtcagggggtggggagctaaaggagggatagcagtaggaggcatacctaatgcagatgacgggttgatgggtacagcaaaccgtcatggcacgtgtattcctatgtaatgaacttgcactttctgcacatgtatcccagaacttaaagtatatattaaaaaaaagtctgagtgtcttaagtattagtcattgctatttggatggtttcttttccagggaaaatattaaaactgtcttgtacctctctattccttttctttctccctaggttttggaaatcactagtgggtaaaaaagaccaatttgcaactaggctctcatgctctgttgaaaactatgtcacaatatcacaatactagatgctgggctcaagacagcaaacagaaagcagtaagttacacatataaatgacaaatatctgattcacttcaattaagtaactatttttttttaatcacaagaactgctttttcccgaatctgttggattgtcagtgtattagaagtgagcatgttctaatttataataggagaagttggagaggatgagcaagaggtttgccccatttctgtaaccatcagagacaaagcaggaggagcctccaaaaattagagcagaccttgccctaaaatgacataagtagctatttaagtgatgtgggcccagcatggtatagccataaatacatccaccacaactgtattaaaaggcctggaatgttcgcttcgtagggactcatacatgatgttgctcggcagtgaaatgatagctaattgtctagtgcggtggattactgtagccaatcacttagcaccatactcttttaattgaatagcaaacgtataggcttgggatgagatgaggctgtctagtatgggttggcatcctggggaggtctgaaaagacagaggcccgattaaaaggcttcaggaggcagagtcagagaggccaacagtgtactttgtctctcataagatttgcttggaatctgctcaacgctaaaagcccctatttagaactggaggttcccaagagatacatttccatcattttgtgagaaaagaggcagaatacgagggagataacacagacgtcatagctggagaataagaatgatttaatgtgttcttggcactgtgctaagtggcttgaggttcacacacctcatctgatccatggttaccatggctgtgcagctccatcatccacggaaatgaaaaaaatacataattgcctacctgtttcaacccatcacccactagacaaactgattgcttaggctttgagttagagctaggcaagtgatatttttaaagctgcacaagtgattctgaattattatcaggcataaaatttgcttattttttacaactcctcaaacaggaatattgcctcatcttctgcagaagatgagttgcaatctatccatctgacaaaggtctaatatccagaatctacaaacaacttaaacaaatttacaaggaaaaaacaaccccatcaaaaagtgagtgaaggatatgaacagaaacttattaccaggcttgagatgtgcttaatttttacaactcctgaagtaggaatactgactcatcttctgcagaaggcgagagtaaagttcatgtttgactgatggagagctagaacctgggcctatcatttctggtttcttggtttttccatttaagacaacagcttccctgaaggtttgaagtcttaggttttgagtaggtaactataggacttccaactgtatcccactttatcctctgagtgattggtccaaaagaaaacaaggaatctacttactgtcagcaggatatacagaaaacagcataggaattcacataccagtggctttaattatggctagttgtgtgactgtgggcatacgaccttgctaagctttcatttccctatttgtatagtggaaatgataaaatgataaacagtatctcaaatttaatttgaatattcaataaggaagtatacataaggtatttaaaatagtatttggcacacagtgggtacccatctatgtgctagttcttgttaccatattaatggctactaatagttttctcttggctagacaatggcatttgtcctattctcttctttttttctttaaacaaaagaatgtggtgactggagagaaggcactagaggtgggacggagttaaagactataatgaatcttgcagaatctctcttgcacccagtaaaaggtgcctaatttctgtgtaaagggctcacgatggaaatcaggttaaaacaaggaacttaatcttaaagccgcgcttgcctatgtctgttaaatcctttattttttcttagacagtgttccagtgggagttggggtggctgatggagacagatggggaggtgaaagcccctcccaaagttgccttttggtgacaccacaacttaagcatcacactttaccttggcctcacttggataaacagattcctctggtgtaattttgtgagctgccagacacagacaagtatgtttatcacttgaatggcaagcttcagcgttagagttgctctatttatacactgctttgcagacaatcctgatgcttttacataattggtgagctccactagcttagcaggcaagtaaataagatggtaaacaatactcttttttctgcacaggcttgtgatgaattctcaagccagctttgcttgcaattagtctggataacttacatattttacattacatgagatgacagttggttttattgcttttcccctaaaagtcgggccttgctgtgacagctacttcacaagcacaggggagcctgctgggcaatgggaagggcaaaggatggcaaattggtctggttccattattgcaatgtaattactcaaacttagccttgctggatttgtgcaacttctctgtaattacataatgatccaaggctcaagagaggctggaggtttggatgcattgcatggcatgtatattcattgtgctgcaaacttccatgacttctagggtaggcattgtggtccgtaagaaattataatgaaggcttggaaatgtatagactgcatgcaggaatcatgcatctgccaaggcacagggaaagtctagaatgccaaggcacttgagaataatctggtttctgtacacagatcttgcctctaaatccttgctctacaaaggagtcaactacagtcactcaggattctggaaagggtctagattcttccaccttgcttccctccactctagaggcagaagagaagagccaacagtgtaggtattaagacagacttacattttgtttccttcagagatgaagtggaagcatctttgactaatgtgtacacacttgaatgtccataagagaagcaaatgcaggcatccaactgctaatgaatgatctaaaagattacttggtagcttttagtataatcctgaaattagttaatggaagtgccactaatgagcatctattaatagaaggcaagtgtagtaacactgctaatgtaatggcctggagctataataaaacatgtgaacaaaacacatctaatactgttctatgttaaaatagctctcttgaaaaacacagagctagaaaatgatcacaactaagagacattttaacaacagggacattacttgatgggactcaccatcaagttttaaatggggtagtggacagtaatacttccagaccctctttccccaggggattttcttgattattctggctgggtatcaaaagttctgatcttttcttagaactctttatataacaaggaactaatatttaaaattcaacatttaagtttgtacttctttatggttctttgttttgtgagttaatatagtctccacagcaaaattatttccaacctgaaaacaggggacctatctatctgtaatagaatatcttccctactgtttttctttctcaccactccagcttgagattgaatgagtaccacactctgtgatctcacagagtgttctgttttcctttctttataccctagtcatagcatatgcaaataaccacatcctttgcagggacacgggatagctggaggccattatccttagcaaactgacacaggaaccgaaaaccaaatacgacgtgttctgacttacaagtgggagctaaatgatgagaacacatgaacacagagggaaacaacacatactggggtcttttggagggtgggaagagggagagcatcaggaaaaaaattgatactaggcttaatacctaggtgatgaaataatctgtacaacaaacccccatgacacaagtttatctatgtaacaaacctgcatttgtacccctaaacttaaaagtttaataataataataataaatctccttgatgaggttctttggaattaggggttctgcctttttgtctctagtcatatgcccaggactaaggcactgaacaatgacagcacggtgctatatatgaccaacaagttagttgtgttgtttagattcagtttgttcctgtatcttaggagaaactcagagaataatgagctactccctgtcttcaaagggcttcaagtctagaaatggttattacccatgttttacatacgtaaaattcagatcatgctgatgaatgaatacccacaagtggaaatgtaatgagaatattcataacgtgggcttaaatttacttttctcttttctaatgcaattatttatttaattaaaaaaccatttgtcttgaggactgcctttcatcagtgcaagtgttgacaaattcctgttcactgctatggaatacagaatgatgaaagtcagtcatcccatatattttcattgcagtgtaaaggttacccaagctttgacatcatatacataatatttttccctgcctgcagcagacattagctgtaagtatgcctatgcaaagatcacatacacaccacaagaatcaaatatgcttatgtaagaattcttatacttaaagcagtatagatagatttagtcttcatgtttatggctacatgatgtggaaaaggctgcggaaatgctgctgtctacattggcatgacattggaattaaagccaactggaggcagctgcagctgtctacgaaacaaatctggggaattcaacagtagaagccaacggctgcagccaaaatcccacagtggaaaaagccctgctgtgggacctggcattggcagtcatgtgttggcatcactgaacttcatttaatgaaagacccccaggtcttcactgtgggccaactccattactgccatattctagtcctcattaaaggtttgggtggcagggagcttttctatgcagatatctgctgccatctatgttgaacgcagaaatggtaggcgagcctcaaagcagtttaaaatccacctgttttgatgcataaatagtcaagtaactagacttgatcaccaatccaaggtgaggtgtcaggggtggaggagggtggaaaaaagctatacctattgttagagaaatttgcagaatgttttgattatatggaagttattcactttacagttccttttgcaaattacatattttactaaattgtctccttttattaaccataagaaaggaaaagcaagcataatcttttcatatactcaagccatcattatggttaatttcataatggtttacatgcagtgccaaaatgttcacatgctagcaaattatttttattttatacataatctaataaccataaccataaagctgaaatgatttctagctttcattttgaccatgtccctaaaagctgtttacctggctgctgatcacatgtaaactgaattggttccttaacaaagggatgaaaattgagtggaagaggtatcaattagagaaactgaatggctcatgaccctactaagttgcaagaatactattttcacaattgtaatgataaaaaataaaaaaatgaaaatgccactgttcaacagaaatatattttcctataaataaatatatttgtaattacagataccaatcacaacttgggcattaattaaacagagaaaacacttaaaaaaaatctgttgttagagaatctccttaatttttttcaaagctgaatagaacttgtccttgcattaaactctcttctgtgttatctgtgcagctgcaaaactttattcattcagtcagtcaaaagttgatattgtttgcaagactctccaatggcaaatctcctaaataagtccttacagctcttcatattttcacaacaccacatcagtgtcattaatgtgcatcatctccacgttccatcctttcctggaaaggttcattatgatcctccaaacataacctaacaactatacttttctagagtgcttctggaactagccaggcaaaattcgtgtgctgtatcttatatcttactttttgccttcctgtattgtgtgcttggttctttaaaaaacagttatgcacatgtaaaaaaagtattaggcaaaagtatgcaggttaaagatatgtacacctaagtctagttactgatgattatagcaatagcaaaagataaataagttcatatcttttttgatggaatcacatatcttttatgttgttattgttctatgaaaaatcttagagatcaactaaaccaaaactcttattattcaaatttgaaactgtagtccagaaagaagaactgattggttacaagttccagagctggcatcatcagagctagggctgcaatccatctctagatccccacttgggagctttttcttaggctccacgctgaaagacaagccatcctatgataagtactgaattataggaaggtctcgctagtccagaaacattacaggttactctaaagattctagttttgctagatgtgtcttgtcttcccctacttttgtttatagaaatccttggctccaaataaagcctgtgacacataagcttcttgctgttatcacttttttcatccctttaacacttcctggaatgctgttaccttcactacctcattctaattccatcagtgcttctttataagcagcccacaggatggctttcattataacagccacacattgcaccttggctcaagtgagaaatgctgcttagatccacaaggtaaaacaaaataaacagttgccttcacctgtttcacaatcttcattctacatcaactcttaatcactataaaggatacacatgataggcgtgtgcaaattagaaatggttcaaagaataaaaatgctactatgtgatcagtttttctttaaaattataattaattatcatttagaattaatgaacatatatggatattcatgtaaaatttaatgcaaaatgttgtaagcaaatccagttctgctctataccatatttacttacagcttacaagaacaaaaaataaatgtactttcataaacagattactatgatggttctgttcactctacatttaaaacagccactttgtcattttttgaaaacttgcctcatatgggagggagttctccacatgcagatgtctgctgccatctatgtggaaagcagaaatagtgggtgtggtttgaaacaagtctcttttgtgtgatgcacaaatactcaagtgtccagactttatcatcaaaccgagtggtaagttggaaatgaagcccaatttttagtgacctgccacctctcctaggccttgcttgattctctgaacgggactcatagcttctacattctccctggcctgctttgccttagggcataagataaggaatgctcagtttccagaagactgagaaatgccacttctacaagagaggtgctggttcttggcacagttgctttctgagctgaaaaaaagtgccatgacatgtacagaactacaatggagttaaattctgaagagtgtaatatatgtatgcacatatattagacacgggaaatgtgcatatgtaagaaatggaaaatgttcattggacttatggcattcacatctaattggggatatacctgatccacatctacaggtctttagggttgctcaggatttcaaatcttcccatttaatctttataggtgatactttggagggtggctgcccatttctctctaaatggctatatctagtcccccacttttcacactcttttttttattttctttgagtctcagttgaactattcattcttgtcttccagaactcacttcaaatgggttttccatctatcatgagtctagtgttctcacctttgtcttacaattaattcttctgcagatcccctcacactgatctcctcccctgagctttggacaattatattctctcatctctttcacataaatcgcacttggaagacaaactcctcaggttaagctgccatctggtgtgtgtatttttcatcaagaactagcaacacccacatcaatagcatccacctttaccatcacctatataagcaacttactttgggaacctatttccttatttcagcattctcatttgaatcaatctagcctaggttagggacactggaaccaaacttggctgtccctggactggcctgggatacctataatataggagggactcgacgaggaactggaggtgtgagagcaaataggaataagatacagtttctgagatgaagaatctaataaaatccaatagaatggggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagtttttttttcaagggatagcaaggtttatatagagtggtgtgcctttcgaatggcctctatttacacaaagagattggggattaggggaggatagggaagggaatttaaccttacatcctcacattgaatggcctttgtggaagcagtcctaataattttccattactgtccaactttgtattctgtttttttttttttttatatactttaagttttagggtacatgtgcacattgtgcaggttagttacatacgtatacatgtgccatgctggtgtgctgcacccactaactcgtcatctagcattaggtatatctcccagtgctatccctccccccccgccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgctgcagtaaacatacgtgtgcatgtgtctttatagcagcatgatttatagtcctttgggtatatacccagtaatgggatggctgggtcaaatggtgtttccagttctagatccctgaggaatggccacactgacttccacaatggttgaactagtttacagtcccaccaacagtgtaaaagtgttcctatttctccacatcctctccagctcctgttgtttcctgactttttaatgatcaccattctaactggtgtgagatggtatctcatggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttctctctgacggtagtttcttttcctgtgcagaagctctttattttaattagttcccatttgtcaattttggcttttgttgtcattgcttttggtgttttagacatgaagtctttgcccatgcctatgtcctgaatggtaatgcctaggttttcttctagggtttttatggttttaggtctaacgtttaagtctttaatccatcttgaactgatttttgtataaggtgtcaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtatcagtaccatgctgttttggttactgtagccttgtagtatatagtttgaagtcaggtagcgtgatgcctccagctttgttcttttggcttaggactgacttggtgatgcaggctcttttttggttccatatgaactttaaagtacttttttccaattctgtgaagagaggcattggtggcttgatggggatggcattgaatctgtaaattaccttgggcagtatggccattttcatgatattgattcttcctacccatgagcatggaatgttcttccatttgtttgtttcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgattttggtacattgattttgtatcctgagactttgctgaagttgcttatcagcttaaggagattttgggctgagacaatggggttttctagatatacaatcatgtcttctgcaaaaagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatagtggctgtgggtttgtcatagatagctcttattattttgaaatacgtcccatcaatacctaatttattgagagttcttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttcatcaatgttcatcaaggatattggtctaaaattctcttttttggttgtgtctctgcttggctttggtatcagaatgatgctggcttcataaaatgagttagggaggattccctctttttctattgattggaatagtttcagaaggaatggtaccagttcctccttgtacctctggtagaatttggctgtgaatccatctggtcctggactctttttggttggtaagctattaattattgccacaatttcagatcctgttgttggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgagtcttctctctttttttctttattagtcttgctagtggtctatcaattttgttgatcctttcaaaaaaccagctcctggattcattaattttttgaagggtttttggtgtctctatttccttcagttctgctctgattttagttatttcttgccttctgctagcttttgaatgtgtttgctcttgcttttctagttcttttaatggtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagagctttacttccaagtatgtggtcaattttggaagaggtgtggtgtggtgctgaaaaaaatgtatattctgttgatttggggtggacagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatctctttaccattatgtaatggccttctttgtctcttttgatctttgttggtttaaggtctgttttatcagagactaggattgcaaaccctgcctttttttgttttccatttgtttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacaatttggcatgattttgcagccgctggtactggttgttccttcccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcccccactctcttctggcttgtagggtttctgccgagagatccgctgttagtctgatgggcttccctttgagggtaacccgacctttctctctggttgcccttaacattttttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagcttgttttccaacttggttccattgtccccatcgctttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgattgcatcagctcctgaggcttctgcattcttcacgtagttcttgagccttggttttcagctccatcagctactttaagcatttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggacgtcctttctgtttgttagttttccttctaacagacaggaccctcagctgcaggtctgttggaataccctgccatgggaggtgtcagtgtgcccctgctggggggtgcctcccagttaggctgctcgggggtcaggggtcagggacccacttggggaggcagtctgcccgttctcagatctccagctgcgtgctgggagaaccactgctctcttcaaagctgtcagacagggacatttaagtctgcaaaagttactgctgtctttttgtttgtctgtgccctgcccccagaggtggagcctacagaggcaggcaggcctccttgagctgtggtggactccacccagttcgagcttcccggctgctttgtttacctaatcaagcctgggcaatggcgggcgcccctcccccagcctcgctgccgccttgcagtttgatctcagactgctgtgctagcaatcagtgagactccgtgggcgtaggaccctcccagccaggtgcgggatataatctcgtggtgggccgttttttaagcccgttggaaaagcgcagtattcgggtgggagtgacccgattttccaggtgctgtccgtcacccctttctttgactcggaagggaaactccctgaccccttgcacttcccaagtgaggcaatgctcgccctgcttcggctcgcacacggtgcgcgcacccactgacctgtgcccactgtctggcactccctagtgagatgaacccagtacctcagatggaaatgcagaaatcgcccgtcttctgcgtcgctcacgctgggagctgtagaccggagctgttcctattcggccatcttggctcctcgatcgtcttctgtttcttactggcaatattccccaagctagagctatgcaatcagtcttctatattccttaaatctgtatagtctattgtaaagttaagtatgagtttctattatataaattaactcaagtattgttcagagattttacttatataaattttttttcatctggaggaaattaatgtatatcattatatatagaagccattttctcctgaaagtaacaatgtaggtactttgatgttatttgcagtgaaatttacctttacagggataactgcagtaaccttttaaatgaacatatgtatatatgtgaacttgcacctgttattgttgtcatggaaacagttccaaaacataagatacaattctattattgaggcagtatagttccccaaatgaattttaatgaaattgcagcagaaaaaaaaaaaagaattttatggaggcttctaaattatttagtaaagtttgccaactagaatctgactacatcataccatagtaatcttcacctaaaaaggaaacaacagtcagcaaatgtcaatcatgcaaaaaggggcataaagtaggtttatttaaaaagtgaacacagtaccccaattctagctttttagtgtctatctttaatattgcccaatcactactcctattgttgatggaagtatatttgaccattagctgtctgagtggcacacaccaagatcactgagttatctggatttttttcctagtttctgtcatctttgggctttctattgacatgaggtgaatagatttagggctagaatgttttaaatgctgagagacctaaaggacctctatttcaacccattgcattacagattagggaaccaatgcctaaaaaagttaggtgatttgtctgaggtacacaagtaaatgtggcagggctgcattaggggttgggtttctgactctcctcctcccatgcacagtcactgtgctgcctcgtgaaatacagccctctctgctgccagttacaactggtgcattctactccagcctgggcaacagagcaagactctgtctcaaaaaaacaaaaacaaaaacaaaaaaactggtgcattctttcataaaggaaagaaatcaaattctgaatgtgaatacctgaattttcattccccacttacattgttacaggagtgaagtacaatttgcttaatgaaataaaatttcagtatcctccttagtgtatgtatctcctcactaaatatgttgattgcatgtagattacttcttttacccatggaaaccgaacgaatatcttaatgtaagaagagtagttttctcaatttgtaaccactgcttcacctcttctgtaatccgaagtcatgtgaatgaaatgtcccaggctcataatgaagccaactgtgaaaccagcgcttacctccaagtcaagagcctgggaaacatctatggagcttagcttaaaactatctgatgatgaattgggactccagtatatcattttgtgcacacagttatggcataatatttgggggaaaggaagccttcacagttataaaatatgagtgggaaatgattatccctagatacagagagtacttattatgtaactgttgttaagggctgacgacatggcaggctctgtgccaagtcaagtctccgacggagcggaggactccccaggctctagaaggcccctgagacagtgtgtcatacagtgatgaggggtagaaaatactctaaccattcaggatgtgattgttttggcttcctctcggctgagcttttggcacttgaactggacccaatgcaacaccacagctgggaaatgacattatttggattggttaagaggagtttttgaagcaaaccccactgtagtattagagaaataaaaaaattcctgctatatccaacaagtcccagagaggctgtctctctattgttcacatgtttggacatgaatgtgcatttatgaacacttttttgtataaatacacagatatataagctatgcaaagccatataaatctgtactactagaataattcattccataaatatttcttgagcattcactacataccaagcacatttttctagtttaaaagtgaagtcgggcatggcagctcctgcctgtactcccagctacttaggagactgaggcaggaggattgcatgaacctaggagttcaaggctgcagtgaaccatgatcattgccattgcactactgcctggatgacagaatgataccccgactcaaaaaaaagtgacccacatgtgtatttgtcacttttaaaatagagacaataaatttcttccgtgatttttaaagaacttaaaacagaggtactattcaacccagcaatcccattattgggtatatacccaaaggaaaataaatcattctaccaaaaaggcacatggacttgcacgttcatcactatgccattcacaatagcaaaggcatggaatcaagtcaggtgcccatcaacagtggattggataaagctaatacggtatatatacaccatggaatattacacagccataaaaaagaacaaaatcatggtttttgcagtgatatggatgcaagtggaggccataatcctcagcgaattaacacagcaacagaaaaccaaataccacgtgttctcacttacaaatgggagataatcactgagcatacacggacataaacgtgggtataatagacactctggactacctggaatagggggcatgggttgaaaaactactttatcagtactgtactcagtacctgaatgacgagatccacaccccaaacttcagcatcacacaataaacccgcacatgtaccccctccgtcaaaaataaaagttgaaatttaaataataaattccttcctcacaggtattaaaaagcacaatgtgagtaaagtacctgatatgtgaccataaatacctgtccccctttgacctcttctttgccctcccctaaccttgaggtgtgattaaccttcctgccttttcaaattctgaagaccacaacagagtagggaaagaagagtgtgaaggtggtccatctaatcccaattcagagcctgggacagacacccatactgaatcctctactttagaaaagaactccacaggctttgagagtgacctgtcacttgtcatagcccctaaggactatgagctttttcaccataagcattgcctatttgttccaatctagtaagatcagatttatcaacagacagaaaaatagatatcagtttttttcttattctaaaaacaatatgtttatgttgttgaatactgggataaaatatagaaaatattaattattcataattcctaatccaagcagtgttccactcaataatttgatctatttcctatagtttgctactaacttcggggcagatctccagaaaataaatattgatggggctatgatgtctccattttgactaaatatattgttatataaagtggtaacgccttacaatttaagtgtgagaaggatgtgtgtgtgtgtgcgtgtgtgtgtgtgagagagagacagagaatatgaatatgaatatgacaatactttggagaaatgtgtccattagaattttaccacaagccagactgaaaacatcaaagatgtttaagtaaagcctgtttagttctttgtgaatgtaattttggaaaacaaactaaaacataaagataaaaggtccacatttcctttcatatttgcaaataaggcttatttcatgaatggtgaaatcgctttgtgtaatttgtaacctcattgttgtcctggattgcctgccatgctgcctgtgtttatgttgcttctccctatggcatgtgctctgagcagacaagggtataattataaatctccatccactaacaagaacaatggttgcatccagcaactcgactctccctttgtgaagctctacagggataccgtcttgaatgtcaaaggtctacaaatgtcatagaaacagctgccaccacttctttgcattaggcatctctttcaacatttactcatggtattgccttacccatctaggcagaagcaaaccaaaatccagagattttaaaatatggtatctataattacaagaaacaacaagaaaccaaagaggaatacaaatacaaccatgccttgtgtttcaagactttctagacttgcttagaaaaaaagagactaaatttttgtctctgggcaaagttagtcagacgagaaagacaaacttcacatgcaaggtatactttttgctgtctccatttttataaaagcaaagttaatgaggctttgatctttattccatagttattaagattattttcctaaatctgagatcattgcagagatatacaaggtagttctgccaaatcattcattcattccttcaccaaacgtggatacgagtgtctactgaatgtccagtaaaagcaggaatacagacattgaaggctcatttcattgcccttagtttctacatatcatagctgtgatgcatggaatattaaggaaacccctaaatctttaactgagttaattcacaacttaccagagctattttcaattcatgaaaataaaggccaggcgtgtaatcccagcactctgggaggccaaagtgggtggattgcttgagcctcaggagttcaagaccagcctgggcaacatgataaaaccctgcctctaccaaaaatacaaataaataaataaactgggcatggtagtgtctgcggtcccacctacttgagagctgagatgggaggatcacttgagcctaggaggtagatgttatagtgaccaagatcaccccactgtactccaaccttggtgacaaagtgagaccctgtctcaaaaaagagaaaaagaaaagaaagatttctcaagtctaagttcagtatttaagaaaaaataaaaagtaacatcatggctttgagcttgattttacctctgttttagactaagaagtctattcaaatggagcctatggccctgtaacctggctctgggaaaatgaacaaaggaatgcaacatcacatcagcactgtgtatttttggaagggtattgcatttttcctttgtggtggattggtccgtgcacttgaaaatacattcacagtgggaaggcaccaactctgctgcacatttatagttgaatctattttttttcctgacaaatattcaagtgggggaggaattccatgtgaatgctctagtgcctccttccctctgatgagtctaagtgctagataaacaaacattatttctaaaacctcaaggggaatacttgaaactggagcaacgtaagaggaaaagtgggcagaatggatagcttctagggagactgtgacatttctgagtaattactgaggggtctagggtctgggggacaacgctcccatcagcagcccttttgttattaaaaaaaatgaacatctgagcaatttaatggaaagtgctgtgaaaacacagctgcaagccttacattcttaccagatcacctcctctaagctttcctatgtagaaattttgaagctttcctggtatctcctcactagggggttaggaagtaagtaaatacactgcactcttggtttagtggtgggagatacattaggaaagcgtcagtgcacatgaagagacccacaggctaacagccatcatttactgagcatctactacgtgagtctccttctgagcgtttccacatctattatctctttaaatttcccaacaacactaaggtaatgacagcctttcctgctgacctatgaaggccaggctgggagttgtccgatgacttttcctgtataatgtcaccccaggggaagacgttactctgatttttccacctcatgtttttccctggcagttgctgtgagagaatgttgtttttggagctgagtaggcaagtggtgtgcatgatatgaaaaaccaaaaaaaaaaaaaaaaaaaaaatgcaccaaaccccacaaactttctgacagaaagcactcgtcaattttagcctgtctatgcaatgatcgaggccttttcctactgctggatatttctaagtgagaagatcctacctcagttttcagctgggctttagctctgcaagaagtgctgccccagtcagccttggggagatcagtagaggattagttagcagagcagccactggagggcactcctgaaatctagaggcttcttcctcccgaggaaagggttgctggagtccctgcctgagactgtgggtttaacaaagagaaggaatgtctgggggataagtcccagtgcactcattctctggaaaaggtctgctgtacatatttgccaagtgataaggaacctaggaaatcaaaaaccatttgacaatttacagtgttcaaaggtagcttcctgactcttgagttacataaatggctatgttaaaaataggcagccaatataattgagcaaccttaaatggcctaggatatgtaccatatgtgatagccatgaaaataatcaaaagaataattcagtataaattaggaatcattcccactccagtggactcagtcttatggaagtggcacataggagaaacttgggattctgtgatttgtgctgttcatgtacaggtctctctctccctagtgaaactcagctctttagtttgggagcctataccggatctctctgatatccctctccagctctaaacatatactacgtagtcacactgattgtccgttaaatacattcaagtcgttattttccttatgacaaaattcacagtgaaaggccacgtgtccaccagaagaataaggtgcaaatctaaagtgggttagtggcattttctcaggacagagtgcatgggaggacaacatagcaatcctggaagttgacagggtaaaacttttggacactctgactctgtgctgtatgtacctgtttgcttctgctttgaaaataactagtaatatacaagatccacttgaaccactgaatttagcaaaatcaggccaaaccagacgtctttgcattaatattgtcattttgttttatattacttaaaaagtcaaacttttttttttttaatcattccttctcttgactatctgctgctctcctgtgatgtatattgtgaaaaacacattttaaaaccaagacagatatctcaagatagacatcatgttcagtttctaagctacaattaaatctcgtagaatggtaagaggtttatatcagactgttgactgctttatatacattactttcattcgagactcatttcatggatgaggaaactgatgtttacataagtcaaggaacttgaccaaggttacatagttataagaagctgagctaggaccctacaggtccatctcagagacctatgatgttaatcattatgccatatgacctgtcttagactagtttaagaaatagcttctcaattaacctctcttcttttaaaagtgttcataggttttaattccttttttttctgcttaggcaatacttaatttttaaactgtgcacatagaagatgaaatggaaaaatgtattccagatgtaggttttatagttgcacatcttggatatggttggttacacatacactacaagcatgtggtacacatctatctcatttttactttagaaatacattctcaacaggggaaacttgaaatacgcaaactgtggtcctgattccacttcaaaacgtctgcttttattgggtttaccctgcaatcatgcaacttttggccagagtcaaatagggcaactaaatttttttcttgagttttacttggtatggttcactgtaaatgcttccaactagtcctaaagacagactttgttcatttgttcttctatgagttttattcagcagaaccttggataacagcagcttagccaaacactgtggggtaatcactctgctcaggactgattcctgtgcagtcagttcttctgcacatcttgccttcaaggtctgccagctgaatgcactgtgtttccaacattgccctccaaacagacctttcataaggaaaagtcactgctacttcattaattccagaagatggatggtgaagtcatattgctttgatatgctttcagactcaggctgttcatgggaagctagaactctctgaaacagaaaagtttttaaattctggctactttttcataggattctattatgacacctcagaggaattttttttatttaagtctgtcattttaaaggaaaatggttagatgtgactagggctgtgaaaacacagtagctaccagtgcctggcaaagtttgtactctaacatatttctgctaaaaaaaaaaagaatattttccattattgccttggattctttcatcttttcttacatgttaagaaacttaatatctgaagagtgagaaatagccattttagtgtgaaatcatgctggggtggaaaggccagcatatttcttatagattagtattataggagagtttggccattttcctgggcagaagcaaggagttggcaccttggaatcaactcttagccatctgaaggctttgagccttggtgagttttccaaccacagggcattagctttctgcagcctggaatggagcgatcactatccccagagagctgtcatgggtgcaggcagtgctcagcttggcttagttctaccatggtcctgaacagccaggctctaggttaagccaaatccagaagtatcttgttttatttcacttgccacgtgtttgagaaggattaatctcagaatatggcagaagccttagcaaagcaactttagaaaacagcatatatatgtgtgtgtgtgtgtgtgtgtggagagagagagacagatctgaggcatgggttttactaatgttattatttaaataaacccttccttatgctagagcaccagatggtgttacaaaaatgaggaaaaaaggctcagggcatataagtcacgtgtcacattagctgtattggcctatgttcaaataataaacattttaatcactgcagtttataactctattttaaattttttgttaatacattaacagtaactgcttacgtatacatagaattctaataaaaatgcataaataacttacaagaggaaagggacttagggattatccctggaagccctcatttcaaaggtgagacccagtagaaacccaatatgcacagaagttaagtgactttctgaaaggtcttgcaggtaattaattatagaacaggactccacgttcaatgctatgttcactattacctgaaatagacttggaggcaaaaataaacttatgtcagctatactcaatgctcagtaaagtggcagagcaatattttataagcgtgtgttccgtgaactcaaatgtgatgttaggtagtgattctgagtcccttaaaacagattgcttgatttatttaaggtatgttctctattacaccaaaaattgtttatggattttttaaaaactgcactccatggagtaagtaccaatttctacacttttgatgacattaagatatgttaagaggcctgaatgttctcaactatggattaaaaataaagtaccaattagttgggtcagttttctacagtgatttgaaattgatttctaagtttccctattgctaatggctgaatgtttatgttttcccaactccaaactcagaggttgaaatcctaactcccagggtgatgggatgagaaggtgggtacctttgggaagtgattaggtcactcttaagagtgaggttagtgcccttataaaagaggccctggacatctcccttgccctaccatcacaccacctgcaggcacagcgaaaagatggctgtctatgaatcaggaaattgtacttcaccagacactgactctgccagagcctagaccttggactttctagcctctggaactgtgggaaatacatttctgttgttataagccacctagtctatggttctttgttatagcagtccaaatgaactaagatatctattgaggctttattgggggaggtaataaaatatgtcatttttttctaggtttaacaacctatattcaattcccctttccgtgatctatagtatgggcataaatagactgtcatgtgtatccaaattaagatgatggtagccaggagaaagattgaaggtgggactactggctgttgatagccaagatctaattctgatctttagggatttaggttcgtttctggttggacggagttgtattatttatctatgcatagtgaagtaaccttgtgatcataatttcagaacaaacaaaaagtcttcacctcgtgatgtcttttaatttgattccacatcaccaggggcagaataagttttatttctagggacattcattgagaacaggatgacgtgctgagtttcagatgtgatcagcttgccaactgtccctgggtcctttgtgtcctgctgcaatatcttctaggaaacaaacacaatgacgtttgaagttcatcaagttcattgattaagctaagatctgcactactttgtcgaaatcttaaatagaacaaaaaatgtttgatgttatatctctcagagctgaaattaactgattaaagagtctctgttatgatgtctatcaatcaagtaaaaaaatagggttttgatctagaaatgcctatccgtttttgaggtatatactttcaaaaccttttgaaataaagagaacagtggttgcaaaacttttaagtatttttactttaaaaaaaggatagaaacaaagcaatgtgtcccattacatcagcatttttcaaaatttagtctctgtactttcatttgcataattttccactttctgtaatattttcataacccttagtgcttaaatgggtggagaggcctgtgccacagtctccaacaaggtgtcaagggagaggaggtgtttctcttctcccaattcacaccatatttagaagcactattctagatgattcctctaaaaatattcaagcttttaggatcttggctttgttttttgtaaattgtacttaaagtcagtgtgactattaccatcaatttgaataagtgcaatgtatttctcatgttgcaggtagtaaaaattgccaacgaatcacttaaatactgagaggactgacaagctataatttattacttggctcaaaatatgtctctactctgtattatctgcctagatcttacttaacacaggaagggtgtagacttcactgaaatgactaattgatgttcaatttgcagattttaattgaaaaaaatatattttgataagtagcagtacttgtttcaaaggaagataccgttatattaaaaagtaaacatccaaatctattggtctaggtctatactcaaaaccttccgggtgtatgtatgtgtgagatattttaaagtaattctaaccaagccattgttctgtaacctgacttaacaagctacagaacaattccttagcttaaattgttaaaggggacattgtgatgacaaataaataaaacgtgttagcagaataaaagttgtctggaaataagtaaatactattttataatttgggggaaagaaattcaatacagggtaaagagaacaggattttggaattaagctgagttaaaattcttgctctggacaacagacaaattacttaacatgtttgaatttcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgtaagtgcaagcgtgggggggcggtgtcaggagactcgtgtgtttataattctgatgcctatctctctgaagagtgactcttcgagttattcttttcaatagatgtacttatggaacataatttggtcatattgtagtgatctgctactaaagaaactttcgcctaactttctcctagccaaggatgtgagtctctcaataacccacatttacccatgagttatgttaaatgtgccttgtgttccactggtttagaatttggggtttggggaaaggcaaatgggatgttttcccagtgtactttagcacaatataggtgaaatcatacatgtatatgcaaaaaaagtacctgtaactgttctgtagttccaatgattgattggatcacaatactaaggagggtcagaatttgatgattattctggctttttgggtggccccaaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggtgtgaaaatgattctcttttttgaattaaaaaaaaaatcaatagaaataattcagtgtgtgaggtagataagcttcagacaaagggaaaaaccaaacctgctagtcagagatagatataaaaaagagaaaaatcaacctctacgttatgttgccaaggagactgtgtaaacagacttacacaaagagaagtggctggctggcaatactgctaatgtggaaaatctcttcattgttgtgtggcatgcttcatctcagaagagcaggaaaaggtggcaggcagagagggagaaataacaagaatggaagagtcgttcttccaaaaagggccatctgtgaccctgagagataaacctggcagaccagggctcacatcttagtaaatcacctgtaaataaagcttgtaaggcctgtgcattgtctcatgattattttattaataatactttaacccttgcaatttgatacgctgtgcaaggtagtcttacaggggatcttttcattgagacgctcaacttgtttgttttgtgcttctcaggcaagggcagtgactggaagctgggagagagggtcaacagctgaatctcagcctgatggaggccaccatttaataagtaaatacatgcacggtaagcctcatatgactttcgtctctctattcttttagaagttggtctaatccaaccatatatacaaatgcaattatttctccttcaatattttcattcattcaatatacatcgggtattatgaataaagtccgtgtagatacaagtagtctcagttccccaaaatgtttagagtgtataataccaaaaaatgctattataaagtttagtgagaaaaaagtttgtttttatataaccatatatgcaatatgattacaaatctgctaaattgttgagcaaacaataaatggttaatcagtgttgatggatgagcaaactatgaattattttccctcttttaattttcatctccaaattttctataatgtggttgtatgaatttattcatatagagagaatttacaggtggctgaagtgaatctgggttcagatgttggacttcgcggtttattcttttacagagtttgagataagccagtgaagtctgacaaaatataaagcagctctttctgcatttgcaaatatgtgtgcagtttttttttttagatagtacatttgtattttgattgattgattgagatggagtcttgctctgtcacccaggctggagtgcagtggcatgatctcggctcactgcaacctctgcctactgagttcaactgattctcctgccccagcctcccaagtaactgggatgacaggcgcccgccaccaagcccaactaattttttgtgcctttagtagagacagggtttcaccatgttggccaggagggactcaaactcctgacctcaagtgatccacctgccttggcctcccaaagtgctgggatgacaggtgcacaggtgtgagcaatcacgcccggccaagatagtgcatttttaaatgtttctctccagacctgtcatcataaaagttgcttgcttagaagggggataaaataagatgcaaaccagctcttcttttattggagagtttcaatttaatcagaagctgaatgttagcacatatatatatgtgtgtgtatatatgtacatatacatatatatgtatatacatgtgtatacatatatgtatatatacacatttgattccaataatatatattttgagccaaattttatatgtatgtatatgtgtatatatacatacatgtatatgtatgtacatatatacatatgtgtgtatatgtatgtacatatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtatacacatctatacatatttacatatacatacatgtgcgtatatacacatatgtatacatatatacatgtacatatgacgtatatatgtgtatatacacatatatacacatatatacacacacatatatgtgtatatatatacacacacaatggaatattgtccagccatagaaaataaaatcctgtcatttgcagcaacatggatggaactggaggacatatgctaatttgaaataagcaaggcacagaaagacaagtattatatgttctcactcatatgtgggagataaaaaagtggatttcatggaggtacagtagaatggtacttaaaagaggctaaagggcctggcgcggtggctcatgcctgtaatcccagcattttgggaggccgaggcaggcggatcacctgaggtcaggagttcgaggccagcctgaccaacatggtgaaaccctatctctactaaaaaatacaaaaagtagccaggcatggtggtgggcacttgtaatcccagctactcgggaggctgaggcaggagaatcacttaaacccaggaggtggaggttgcagtgagccgagatcatgccattgcactccagcctgtgcaacagagccaaactctgtctgtctccaaaaaaaaaaaaaaaaaaaaaaaaaggctaggaaggacagcaggagtgggggataaagaaacaaacgttggtttatggtacaagaatacagttagctaaaaagaataagttccagtgtttgatagcacaacagggtgactacagttaataataactgattttatatttcaaaatagctagaagaaaacttctgcatattcccaacacaaagaaatggtaaatgtttgtttgagatgacggatattctaattaccctgatttgatcattacacattttatgcatgtatcaaagcatcacacatactctactctagaaatatttataatcattatgtcaacaaaaaattaatataaaaaaagaaaataaaagctaattccaactgctaagtcattgataaattaaaaatagaaatgagattggggtcttaagtaatttccttacattaacggtcaaaatgaatgccacaccttgtgagacagcatgcaaaactcagtttcagagctggcatattgaattaataacatatcctttttctatcaaaatgctcttaagttgtaaatcatgcttttttgttttttttttttcaggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtcacatcaattagtcaagaaaatgtgattaccctgagcccaagaaacttccactaaaaagatggaaggaaagactacgtctggtgttctctggcaccatccttgagtccacatgtatttagaagtgaataactgaatttagggccatggtacagaggtgtcagtctgcaaactagaagagcaatgctgacaggccctgggactgttcctagtgctgtatgggaactcagaaatctaaccgaagccacaggatgggtaacgacaatgagactgtgacctggcaatatctgcataatcttgcaagaaatttctaaaaccataagacacacggcatttttacttgagtcctaaaatgaacatccggtgatattggaccttcccactcctaaccaaatgacgtcaacacactcttaaggacacatcacacactctgtggaagagggtaggagaggtgtggaatataaaattccttttttgagacggctgcctggattctaatggggttactctaatgtgttttaagaccaaggctcactggccaagatatactttcatgaattcaagaatgtatgatcattatgatgtatacatatacacatatatgcatttacatgacaaaaaaaatgccagaaggcatgtaaaagacagacagtcctcttttcaaagggtgcataatgggagtgattctatctttacgtctaaagtgttctactggacgcatttaatgttcttgtttcctctgtcttaaattattcgttcccttttggacacattattgctccataataatgctaagtagcttcattttgttgttgttgttttttaaatcacccaacctttcctaatgctaagccaggcaatggagggcaggaaaaaaaaatgtctttagagaaggctgtaggcctatcaccagattttgagctgggctttccccagaacacactttaggcctgcaggatgcctgaggccaagggtacttcctgcatccacagggttggggatgctgagtgcaatccctctattctgccacctgggacagccttttgcattactctctggctgccttcccttttctgaaacttgagaggggagaatgttgcttccctttagaacagtaggtgagcccatcagcaactcagccccaaaagtctctgcagtctcatctgacaaattataagattgagcctatcaagtaagtaaataaataaataaataaataaataaataaatgaataaaatgaatcataacaaatatacatatctgtgtatttattacatcttatcataattctcagcctgaatctaaatatacggtctactacaatctttttaattgggctttagctaaatgcatgatgaaaatcattttcagatcttagctcattggaaaaaagtaaagataaaaaataaataaataaaaagatcttagctcactgtcgtactctagtgccttcctaacacgcaagcatacttcccatgtcccattcacttgcaatcagctactggtggaaaattagatggtcccaaatcagaggaaaccgaagacatgataatgaaactcctgaaaaaatcaatgacgattatggaaattagctgtttaccaccttttttttttttgacctttcctttttttgaccctctaggcagcctagtttatggaaggaacatcatcagtgaggtcccagagaaaggaaaatgactgattacagagatagctattatttccagccactatatccaagagcgtatcagatcactcaaagcacattttatcaacactccccctgtgacaatctagtctttactggagttaattaaagcaattaattcccttccctttcaaagcagtgtgattacataaatagataatttcccaatccaaacccataaagcaagtgatttctctgcatgttcctcagtgtgcaaagcacctaactgaaccaaattgtcctttttctaaatttgaccttcatgaaattctccagtaactttttctgctctgtcttcctatctggttggatggcagaaccacatctccacatggacacaggactgcaagattaataaagcatttcccgcagcaaagatagataatgcctaaactgtaatcacaacgacaggagtagagtgaggaggaaaggagaatggcgggtgcctgctctgacaggcactacagttcccttcaacaatataccagcgtgggtgatgctgacaataattaagcaaacagaatgccaaacaattgtaagaaaagctgtcaaacattttgtgttattatcccctgcacaggcctgtaatttatcatcacagaaaaagcacataaagaaaaatctctaaacagtgacattttgttcaaattacaacccttggcttccctgactgcctacagactgacatctccaaggtcggatgtagtgctcagcaatttgttccttcattaagtgagcatgtctctgggatgggttctagccactgtgagtgctggcatgccaagagcaagaacaaagtacttcccaacgtgtgggaagccacttaccttcagacgtcaaaatgaaagaaagtaactgacattcgtatttccttctcagattggtcctaaagcttgaaatatgatctcctgcaccaaggctcctacctgtcatttcttcctccctctccacccaaaaccctgcttggggttctggacttggctaaagtgtaagggctttgatcttgttggtataaactcagtctttactggccgggcactggtggctcacacctgcaatcccagcattttgggaggctgaagacagtggatcacttgaagccaggagtttgagaccagcctggccaacatggtgaaacccccgtctctactaaaaatacaaaaattagccaggtgtggcggcaggcacctgtaaccctagctacatgaaaggatgacgcaggagaatcacttgaaccctggaggcagaggttgcagtgaggcaacattgcgccactgcacaccagcctgggcaacagagtgagactccatctcaaaaaaacaaaaaacaaacaaaaaacaacaaaaaacccaatcttcctgatgatatcccccaatggttgtaattgaaccagaaagaaaataaaaaaaaaaaaaggaaatacttttctcatccagtttctttagagtttagcacagttctatagattaattactataaattgtgagacataaagagacctcagagatgctgagccagtgagacaggtgtgagggtgtgaggtgttactattagtactttggagaaagtccataggcagtctccaacgtagatttctggatggctcagagttgaaatggaccctagaggtaatagaatcaatcttttcaagtaatgagagaaattctgtctgtgatattcctagctgatgttctgagctggaccacttccaaggatggagataatagaagccttccattacaaatacttggctgctgaaagacctaaacatttgagtcttcactgttttcaacagctccttccacacctgtccaacatagagatccacttaacagaagtcctaccctctagatattgccttatttgaaaaggtaatatcttttaatcccatttctttctatcccattgccagagctctttcccattgctttcttcactttcttcacaatcttttttcttttttaatttttaaaaatagggtctcattctgtgcccaggctggagcacagtgatgcaaccaagctcaccacaaccttgagctcttgggctcgaataatcctctggcctcagctaggactacaagcatgtgccaccatgccctgctaaccccatctcaatctttatacccataagagaaccttttcttagaagcctcttttcttagggtttggaggttgatttactattgccaatatagcaaatctttattttccttaggtttattttgattttttaaaacaatagtctttttactcaaactttggcaaagagtttgggctagtataccaagtaaataagctttaattttctcttggccatgtatcttctattagtttctgcataagaccctcagtgcttccatgtttactgctcgctgcacaggcacctctcactagatggcacttaggatatttttcaaccatctttctgaccaaaattgtatgtgttctatgtctcatccctaagaaagttgatagtgaactcaattggctgattacaagtacagtgtgaacaacttatacctgaacactttaaatatattgcaacctaacaaacacatttacatatcaacaatgactcatttccttagtccaagaaagtgaacacaggcttgattctctctcccaacaccctcccctccttttttctctctctttcattccttataatagacaaatgtgaattatcttcacaacctgttcatttaactctgtcaagctattcctcaaggacaaaccacaaaagggaaccagggaagggctgttcagagctcactgaaaatccagatcagctacagaggtccttagcccatagaagataggtctgtggtctcaacttggaatataaataacagcttctttaccaacctcaccaaatcgacttttaatacctttttttcccataggcttccaacctactctgattgacttaggctgatcagaaacaaaactttaacagtaacgtctaaaataagtgaactttgttttataagtcttccttcttgccaaagctgatgactaaataagttcaaagacatttaaattaatgtcagttatacccacagtcactggaggagaggtaataggaattcaagcttccagtaaagaaaaagaggaaatgagaaagaaaaagaggtgtctttcaactctagttgtgatatagtctgctgaattattgacctttcctttcaaagataagaaaatgtgtatgtggttttttttttttttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactggaaggccagtctggggcgtgcttgctggatgtgtggagatcaattacccacaagtccctgtggagtctcttccataagaaactggggaagcccaggccatcagtattctgcacacacactaacagcttgtgcttgcagaggcaatcatttttcagctcttttcagattctctttcttggttatttttccatcttggctaaaagggtttctcttttgtaccaagcaggggcaccaatctaacagaatttattagaaactgctcgattgggattttgctggagttctactgaggttgaaaatctcaaacaatatgtgatgaaaattttaggctgttttgggtgacttcaatcccaaggtctttcttggctgatttgagttccttctttcagagatttaggcaatgttagtttcagatgggaggtctggtagatcctaaaaatgaggtagctctatgtcagccattcagtggagaaagagcccatgctactctgtatgacaaaatactatgcctttatttgcatacaggtgtgaatgaattatttaaagagaaaaatgtgcgagtgggtactgcgtaagtgccacagtcgttgcactgtgcttttcagtaagtgtgaacattttccttcgcatgtctttttaagagaaagagaaaatgatgatgggaaggattttgggtaagacaagattacttttctactattcttatcaaaatttactattttgtcttcctttgtgtagtacctgtgtaatatttgctccacaattgtaagctccttgaagacatgaaatgtgtcttttcactttttttttttttttgagacagaatctcactctgtggccaggccggagtgcagtggtgtgatcttggctcactgcagccactgcctcctgggttcaagcaattctcctgtctcagcctccttagtagctgggactacaggcacgcgccatcacgcccagctaatttttgtgtttttagtagagacggggtttcaccatgttggccaggatggtctcgatctcctgaccttgtgatccgcccacctcagcctcccaaagtgctgggattacaggcatgagccaccgcacccggccctctcttcactattatattgccaatatttatgatagcttttggtttactgcaagaaacaatgagtaagtagtttgtctctttaaaccaatgctttccattcttctccaggtgagaggttggtatagatttttatgaggctttatcataactaaacccagtggtggactgaataagatcagctggtaaatatagtctttgatccactggaaaatccagcaatatctaacttaaacaacaaatgagcgaaattctaacatttctagtatatttgatctattggtttgtaaaccatcttgaagccatgatatagaaacactaactctgtatttttataaaaataaaacataagggtatgcatttattcattcaagaaacatttcttgagtccctaattgcactaggaactgttcttgattcatgatagaatgtgacagacaggttgttcatggagattttgctcgagtaatgcatatatggttggaactggtgggcacggagtccaaaatagcaattctaggccagcttgccctaaacaaatgatacagatattatatgagagagttgctaaaatttggatcatatttagctctcctcccacctctttcaaacacttactaagtttagggagaaatgtgggaacataggatgaagtggccacagaggtacccaagaatcagtacagtaacaatgtccttagcaaatggccctcccgtaattcctaagaaggtaaaatattttagcattgaaataacttcatgacatggctatgccaactctaaaatggtttcatcatgtaaacagtccttcagcgaatgacttacattttgaaaaacctacagagcagagtgaaaagcatgggctgagcagtcagctgatgaggatgactgaagccatgctccaccatttgctggttgattcaagaggaagtcacttaacctttccaagcctcagcttcacctgcagaatggcaataataatggccaacttgtagagttgttgtgaatacaaaaataatgcagtgcatttttagcatgatacataacatataatagcaacacagtgctagctgtaattcaattggaaaaaactactttaaagttcatatggaaccaaaaaagagcccacattgccaagtcaaccccaagccaaaagaacaaagctggaggcatcacgctacatgacttcaaactatgctacaaggctacagcaaccaaaacagcatggtactggtaccaaaacagagatatagaccaatggaacagaacagagccctcagaaataatgccacagatctacaaccatctgatctttgacaaacctgacaaaaacaagaaaaggggaaaggactccctgtttcataaatggtgctagccatttatggaaaactggctagccatatgtagaaagctgaaactggatcccttcctgacaccttatacaaaaattaattcaagatggattaaagacctaaaaccataaaaaccctaggagaaaacctaggcaataccattcaggacataggcatgggcaaggacttcatgtctaaaacacaaaaagcaatgataacaaaagccaaaattgacaaatgggatctaattaaactaaagagcttgtgcacagcaaaagaaactaccatcagagtgaacaggcaacctacagaatggcagaaaattttcacaacctactcatctgacaaagggctaatatccagaatctacaatgaactcaaacaaatttacaagaaaaaaacaaacaaccccatcaaaaagtaggtgaaggacatcaacagacacttcttgcaagaagacatttatgcagccagaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccgttactgggtatatacccaaaggattataaatcatgctgctataaagacacatgcacacgtatgtttattgcggcactattcacaatagcaaagacttggaaccaacccaaatgtccaacaatgatagactggattaagaagatgtggcacatatacaccatggaatactatgcagccataaaaaatgatgagttcatgtcctttgtagggacacggatgaagctggaaaccatcattctcagcaaactatcacaaggacaaaaaaccaaacaccgcgtgttctcactcataggtgggaattgaacaatgagaacacacggacacaggaaggggaacatcacactctgaggactgttgtggggtggggtgagggagagggatagcattaggagatatacctaatgttaaatgacgagttaatgggtgcagcacaccaacatggcacatgtatacatatgtaacaaacctgcacgttgtgcacatgtaccctaaaacttaaagtataaaaaaaaaatagagcacacatgtcattaatgaccattaattatagcaacacccagaggacagcagtactgtatcattttgcaggtaagaaaactgaggcttagagggtgtttatgagcacaggggaagatacacttcacctttctcttgaagttattatgttgccatgacttgctttggctaatgaaatgtaaatgacagaggaatgtgttgcttcttggtgaaaatcttcaagtcatcttctcttcactgtgccacaatgaattatgtttcagaaggcggattgtccaggatcctgtatcctgaattaaggacaatgtagagtagacgatgggcatgcagcatgagtaagaaatagatctttattattttaggtcactgcaatgtttacagttgtccattacagcaggataacatagcttattctaactttccaaagatgagaaactattaagatctagcattcaaactcaggtcttatggtattaaggccaatgcttttgtactaccttacagtacactgcttattagaaataaaacaccctgtgaatgtaccttccacttcgaagaaaatggacttttctgttgctctttgacttaaaaaaaattaaaaattctctgagcaaaggtcaatggaaaggtagcgaaaaagttggtagaggtgggcagataataaaactgatgagaaagatccattagtttagcagaaccctttatttcccataggttcatgacctgaagattacataggatggagggaggcccttatcataagcctgcaattctgtggctaacaaaatcaatttttaaatgatttatgtgatgtttttcaggaccaaaagagcagtaattcatttcccatgtggtacttggagctgctgcttagatgttgaaaaatgattaatctttatttacagcatggctcccttcatatattactggaaacaagatttgagagtgcaacacttctatagcatgcaattatttgctgaaggaagttccaggcataaagaaaaaaaaaatctactagcagccaaggatatctggacatgcactgaagtaaccactgtgaaaaccttccaaggccaaatgcttccaatctattcagtttgacccacttaacataaaaaagccacattaatttcccaaggggagccactcttctatcaaatcatactaactcctaacttcaacaatgggagaatgaagaattcagaattcttaggtttttgttcccccagaagactgagtttaaaaattttctagaaattggtgcacatagcttacttcaacttaagttgaaatatgtgtgcatttttaaaaattgctataaggatgccttttctgggccaccatatgtagacattcctttcttttaaaactacagaagtaccatattctcaggtctcctattctccatcttgccagcctgagcctaacaggtccaatcacatctaaggaacagtttcacctagggtaaagttcacatttttatgactagctatatcactctgaagcccctagtttagggcccacaataatttgataaggacaggtaaatttccatgtcccttgcatcttgtgatcattaaggttggggtaaagaccttggatatcaaggagatagagtagagactattcttagaccattggaatgagctctgcccattgcttctggacactagaatgttagagggctgtggagaatgatgcgtaatgatgcctgctgttttctctcctatcattttctaggacagattttcccaaggaaacagttaagagagccagactagtcagttacgcactccatactggagaccactcatatgcacattgtgtacctcatccttctccatggatcattgctcactttctctttattgggctaatggtattggttaaactgtaggctgatgactatggaccactattttctgtatcattaaacatggccatatcccttcaagtgggttgtgaataaaattggcactctgcttccaccccaagttggattatttaacaggcatgactggcttattaggaaatagcttgaactggtatgactgaggatgaaacatcttgtcaatacaggttatttgttaggtcccatagaactggatgtacaggtaaatgagggggtgagggctttccctcctgtttgtagtttgtatgtggggttcatcagcaaacttatgaagcccagtttattaagtttcttgggcaaaagagtaggcaaagctgttctaaatagagtaggaataaaagagggctggtaccacaataatggtgaggcaatttcattaactagagtataaacaagaaaacaaagtaacaaggagtttgttgatgtattagcaggatcctggatctttacttgcctgagttatctggatgagtcttttgtctctgggtaacttcagtcataacccttatcatttataagtaacacagggacctgtgctgggaaaatatggaccaatatcctagaaagttagtaacatatacttagtgagtaagcttgtaacacatacgagtgaccaatgttttcattaatattttcctgtcatgccaccattctgtgtactatgcttttcttcttgagtcctgtagttgcctctaagaatgacagtcctgggaaagatgctaattactcaacagagtatttaattgcttgtttgcctcaactcagttgtaagctttgtgaaagcaggaaatatgtgtattgactgtctatcccagcaataattgccatgcctggtatgcagtaactatttgtggaatgaatgaatgaatgggaaaaaattatagattctgtcatttattaatcccctactacagagtatgacaggttgagtgttgtgctacgtgtttcactaaccgtatttttgaatcctcataattctacaaggtagatattattttcctgatattataggagaataaagagcttcagtgagtttcaggtgtgcatcgagcacacaaggaactgttttgcagagagtcccttctctgtgacagtcagggcccctcccacatatttccttgagtagctccctcactgggtatgcaggatgacatgagggagatttgctgacagccacccttttctgttgagcacttatctctcggacagtgggatgagaagaagaaggaaaacacaattgttgaattacgatgggcattttacacattttatcacatttaatcctgaaaagaaatctctcatgctgacacaattcttttaataaaatgagtaatcaaaagttaggagatataaagtgactttctccacagtgaagagccagaattccaattccactccattgtgtgtgtgtttgtgtgtttctttcccctccagtgtcctttgagtgtagtaccattaaaaacttagaatgcttgataatggcagggaccaggtgattcctggtccctacaccatactcactaaagtgaaattcctgaaaatggctctaggaatctccattttcaacaattcactaagtgggtctaatgcaaagtaaagtttgagaaacattgaactaggtagagttgcctctaacatttttcatgcacttggataatactaggagccagaaggtctacaaatggaagaaatcaccctgtaccaagcactggtggtgcatttgcagctcaggatatggggaatgccttggtaccccccattaatgttaataggaatcatgtggataattctctatattccacgctgaaaagtgttccctttaggaccaggagaggctatatttaatcaaaccatctgaaatcctatgtacgtgtataagggcagaaaataggtcacagttggtaggctactttctgggaattattccattgtatcagcaaactccaaagtcctcaaagggctcctgctctcctggctctcagtgagtgacagcccaagaactaagagaggtcagagaaagtccaacacttaaggaaaaaaagttccaatcacaataaaacacataaaacaaattatccccaaaggacaaagtgtggaataaacttgttaaaagctattaacctctcaaaataacacatttctactccagagtaacctcagttgcagcttggagagcagcatgaaattaaggaacacaattcagagaacataaggactccaaatatgaactcatgatgtccaagggttttacaggcactcatgctcctatgaaaaccacgaagatgatgggtctatgagacctgagagagtcagataatctggtgttaaaaagtagtgagtgttcataaggcttccagaactcaactctattatagactaagaactttacttcgtcaatcaatccaggtttttgtctttattatagaaattataggactgttagcttattttaactttataataacatagcttattctaactttccaaagatgaacaactattaagatctagcattcaaactcaggtcttatggtattaaggccaatgcttttgtactatcttacagtacactgcttattagaaataaaacaccgtgtgaatgtaccttccacttcgaagaaaatggatttttctgttgctctttgacttagaaaaaaattaaaaattctctgagcaaaggtcaatggaaaggtagcgaaaaagttagtagaggtgggcagacaataaaactgatcagaaagatccattagtttagcagaaccctttatttcccataggttcatgacctgaagattacataggatggaacattacatgatgaatcttaaagcaagaagaggatatatttgggttaatctggatttgaaccttggtcacgtcttggaggaggaagccactgattgtaagggagcatgaagtgaccacacagaggtggtcactgtgctcagcagcatttcaccttgttactccccaccgctgtgttgcctttctcatggatcactgtgactgttgctgttttttttttctattttattattattatactttaagttttagggtacacgtgcacaatgtgcaggttagttacatatgtatatagcacaaagtaagcagagatatagaaaggtggagaactaaagtcttcaagggcatatggcatgcagggtgaatggcatattttacactatttgctttttggtatgtctgagatcctgatagctccttaattaagataatcaaaatccctagtctagagtgggcaactgtacaaaattcttacaataaatggtcagtaggtcttcaagctagctctcatgtaagctatgctatccctgaggcataaggaagggcataaagccccagaatgactaccactgtgtctatgagacaattcaaaagtccagttttttatgccaggatactttcaatttctccatcataggatcagggaccttccagccctagcttcagatccacagtggtgccagaagcactaccaaggaggatggtgtaggaaggtatattccttttctaatgctgctgtaacaaattttcacaattggtgcaaaacaatgcaaatttatcatcttctagtttgtatgtcagaagtctgacacaggtcttactaggctaacattgaggtgccagcagggctgtgttccttttcggacaatctagaggagaatctgtttccttgccttttccaccttctacagatcacctgcattccctggcctttggccctttcctctatcttcacagtcagcaacattgcatctctctgactgtccttccatagttgcatttccctctgactctacccaggaaaagcattctgcttttaaggacccatgtgattagattggaaccactgaaaaatccagaacaatctcctcatctcaaggacttaatcacaccttaaaagtccccttcgccaagtcaggtgacagatacacaggttctgggaattagaacatggacatcttgggtgggagcattacattattccacttaccacaggtggtaagaggtggtgaggagggaggtttccagagactgaaaagatctaagataagaagctggcagcaggagggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaaaactctctaatggctttctgtcacttagaacaagacccccaagcccccctcatatggctgacagagcgtgacatgatctggctcactactcctctctcacgtcccctcccactcctctcccacctcccctcccactcctctcccaggtgttatcaggctccagccacatggcccccttgctgtttctcaaactctccaaaccagcttgtgtctcggctcctgtttctccctctgcatggaagggttgaccccggatctttgcatggttaatttcttcccttcttttcaggcccagatgaaataccacctcctcagagaatttctctgaccacgctcactaaaataccaaccctttctttcactctctaccccctcactgaacctatttttcacagtccttaccacgacctgacattacattatacattgatttgtttgcctattttccacgttgattatttgtctctgccactagaatgcagaagaaaaagtttctttagggcaaggaactccctgggagccaagaacagtgacttgcacattggaggtattcaaataactgttgaatgaataaattcaatgtatatttgatgagcccttttaagtgaaagacaccgtgatataaacagtgaaaagacagacatggtctacccttctttccccagtgtcccacggattgactcattttctttccggagtcaacttttactgatgaccaaagtttatttttattattttatttatttatttttttttagagtcagggtctcactctgttgcccgggctggaatgcagtggaaccgtcatagctcactgcagcctcgatgtcttgggctcaagcaatcctcccaccttagcctgctgagtagctgggactacaggcatgtaccaccatgcctggctatttttttggtattatttatagagatggggtctcactgtattgccctggctggcccggaacgcctggtcgcaaatgctcctcccacctcagcctcccaaagtgctgagattacaacatgagccactgcacctggccaaaacttattttttaattcccaattccatctcatgtctctcctttgttcttattcatttattcattaatccattcaacacatgcttattgagaacttaagctaggtccataatagatcgcagtccctaaaacaagaacatgatcagtttgggagggttcttttcctgatggccattatgtgaagggagataaggagggagaaaggttctacccacactcccactactctctccctcctaccctacagacctcctcttttttccatctgaattcatttgcagacaaggatgaaagccccttagagtaataacagaagctccttaggtaaacaaaatatttcagtaatctaggagtccatagggggctaacactgcagagcctgtgctctgaggactgggtcaggtccctgcacctgtgcagagcctgccttatctgttgagaagctcgcatgagctcaccactaaccaagtcacaacaagcacacagttcgagttcccaggcaggctgagctggcagtgcatcaggcaatgcccttttaacatttttcacttcttgttcaccgctgttcttgcaattctatgttttacttaaagaagatatgctaaataaatggttctaaattagcctgagctaatttcagccttgagctcactctgctgccacagactctggcaagtacgatttggagcactgacacatggcctgtgtacatgacaagatgtcttatgcaaagttagtttgggctatatgtagggacatgcacacactccaaatattcttttgttttgtttttgagatggagtctcactctgtcacccaggctggagtgcattggcaggatctaggctcactgcaacctccacctcccaggttcaagtgattctcctgcctcagcctcctgagtagctgggattacaggcgcgcgccaccaagtccggctaatttttggatttttagtagagacggggtttcaccatgttggtcaggctggtctcgaactcctgacctcatgatccgcctgtcttggcctcccaaagtgctgggattacaggcatgaaccaccatgcctggccctccaaatactcttttttttttttgtatttttagtagagacggggtttcttcatgttggtcaggctggtctccaactcctgaccttaggtgatccacccgcctcggcttcccaaagcgctgggattacaggcactagccaccatgcccagccccaaatactcttaataaactttaataaactaagaagtctaagatgaagcttcctacgaatggatgagtcaagaaaaagctacacaaagttcacatatcctagtgctgctcattaatttgggagaaaaaagcttgatgtgaggagcttgatttgaaggacaaccagtatggaaagccccaaggtactttataggatgtccaagattagatgctatttattaggtataatagggcttttttaaaacaaactcatacctctccacgttttaaaagtgtggcccattaatcagcaattaactaaaataaggttgttaaatgacactacagtaattctaggtcagtctgattttatcctctttctggcttaatgcctcagatagagtgaaactcccgataaggcactcactaaggggcacttgcacaataaagaggagaagcaggaacgaggaaaacatagttaatatgccaagtcctttttttttttttttttccattttagttgagatgtgctgtcagcctctctcttgaccagggagaggtgcttctacttcaccagggggctctgtcccccaaggctgcggcatgtcggtgtttatgcaagggactgtgcccctctctccacagccccagctgcagcctgtctgtcgccttataaaaaaggcatcgagcactgcttttagatcatttcatcatatttgctcatttccttggctgaagagtctggagtcagagggccctcagaagatgtggaacagcccttgtggatggaatagactgggcactgttgctttctagctgtttgttctccatgatcacatttgcatactagatttctaccaaggaaacctgggtacagcatcttatcatatttgtagccccacataaatgtattgagtaatccgaacttgcttattttgtaaataaacacataatttctgggattaaaaataatctaataacagcaaaactaggctgtccagccccacactgaagggcaatggaagttgtgctctaaaattttccagcagtatcagatgaaaagccatggaatggggctgtctctggaaaatgagcatgccagagaaaccgtttaacgcttgtgtgtaggatggggatctgcctgtgtacacttatgcaactcttttgatcatttgctctaaatgctcattaacagacattttgcaaaagatcagatgatgatacaagcatatcaacaggcttccgtttttactgtagggaacccagaaatgaggattgttgttattttctttagaaaattcatttaactgctgatagtaaatcaaaattctacattgccacttctgtaaatataagtgacaagaagttatatatctcccctagagaaagaacagtaaacatttctaaaatttccaagtgctcctacatataatctggttgttacaagtggaggcggcttgtcagaaggtctctctctgtaaatggataaggattgaagctgtgtcgtgtatcactcatgttgtttatcctttatattaaatggaagctatatatagatacaaaattataatggcacagactgcccatttcctaccagcagtaggttgactaggaaaatataagtaatttactgcaaaagtgcatcaaagttgaagcatttttagctaaaatgcaaagctaatcaaattagtattaaaacaattgacaaatggttaaattttcctattcaatttgaagtgaatagaattgtatgctcacattttataattgagttgaagctgttgtattgcagtttttattattatggaacaagcaacagaagtatagacagatgactgagtaatctgtatatacctttgcaggtaagtaactaattatgaccatgaggcacctacaggacagagaggccataagactcaaatttttgttattatctgaccaaaggagagaacttatgttcttaacttatccttaacttatgttaaggatccaaagagttagctgttaactacaagtgtcacttgaaccttaaatgagtatattacttttttcaaacaaactgctctacctatgaagaacaactctgaggtttatctccaaaagcaaagagcaacatattgtgtggtccttagggtagagcctgcgctcatcacattagcaggttgtccgggaggaacgctgggttgaaagctgaaagggctgggtctgatgatgtttttttctttacgtgggttttacatgagcttgagtaacccacaggcctctctgtagtctgagtttccctggctttaaaatgaaggtcatttaaaaatgatcctcgtcctgtctacctggcagagctgttgtgaacatcacatgggataattatgtgaaaggtgctttgtaaactgaaaaatactataatgaggcagggcacaaggcagcactgactcttgaggctgaatgctctgctggaggtcaggctggatggatgttgttggtgaagtggggcatggtggtttcctattccaggcttgagggctgactctcctgcaagtgggacccccgtacccacagacttcacttagtctccttgaaggattcatttgccacagctcctgagtactccatcagtagagttgactaaacaccaaagatgtttatattctaactttcaaaaagtggtatgcagctacttgtaaaaatgaaacatgtgaaatctacttgtctatctaaattttgccagtttgattggcatatttggcaagcttttgagaagactgggaaattgggcaatcatttgggaaaactggaatttgagatctaatgatcagctgctttgccttcttctttcccctgttacaaagccagggcaagaagacaagacagaggaccttctgatgtgctgcctgatctccactggcttcttttggtgaccacatgttccttaactgagtgtctttataagggaggtattgttgaagtatgtggtgacggactgagaaaacaagcagtgagattgttagcattcatatctcacaggcttaatgagaacaacaagcaagccccaaagggtgttaaatagatttggtatattttcctcatttcagagaatgtctattcctaatgcattattctctagccaacagaagaaaagtgcccagcttattccttcttcatggaaactacaggtttaaaggacagagactctcatctatcaaagcaactgagtgacttctacttaaatcaaggccagcaaagtagatgatagaaatattaagggaggttgcagtcaagggcagtactcttctttccttgacttatttggtgtgtttatggtttcaggaaactatcacctctttaatctttcaaaatacatttttaaagaggccattctttttattggacatttttattttaggttgcaagaattctttatttctctgcttttaaaaatctatacttgacattatccatggccaaaatgatttacatttgttgtggacgctgacaaggcccaacttacattctatgagaattttgtggaaaaaacttcaccttttgtgatggttcaacttagaaaggcttgagtcgaatgaccaaggttagaaagtctaaacagaaggacaatgagattctatgtatcagcctaaagatattcatctgaaaaatatgccatatgtaaattaaaaacaatgatggaatcctgctgcatgaatatcacagttcaaggtgcaagaatagaggaagagaaagttactataataaaaaccataatatatggtttatacttataataacacatatttacatggtatggttataacacttgctttgtcagtttgtcactctgacaagttacttgccctctctatgcctgttttttttttatttttaaaacagagatagtgctgggcacggtagctcacgcctataatcccagcactttgggaggccaaggcgggcgatcacttgaggccaggagtttgagaccagcctggccaacctggtgaaaaaccgtctccactaaaaacacaaaaattagccaggcgtggtggtgggtgcctgtaatcccagctattcaggaggctgaggcaggagaatcacttgaacctcggaggcagaggttgcagtgagctgagatacgaccactgccctccagcctgggcaacagagtgagactctgtctcaagaaaaaaaaccaaaacagataataataaaataatagcaaaagtagctaccttataaggttttcataaaaattaggtggaataatcactgcaaagaccttagcccagcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatctgtaggtatctcagtatttcctgaagtgactgaataatttttttgtttttataaccttgtttatcacatcactggtttttacacttttaatatacaatggttatttttgtagacattaactctataatttatttacctgtatctctaaaaaagggcatcacaggctgggtgcaggggctcacacctgtaatcccagcactttgggaggccgaggcgtgtggatcatgaggtcaagagatagagaccatcctggccaacatggtggaaccccatctctactaaaaatacaaaaattagctgggcatggtggtgcgcacctgtaatcccagctacttgggaggctgaggaggaagaattgcttgaacctgggaagcggaggtggcagtgagccaagatcgcgccactgcactccagcctggcgacagagcgagactctgtctcaaacaaaacaaaacaaaacaaaacaaaacaaaacaaaaagaaagaaaagccatcacaaaatgataaggggagagtagagtaactttgcatattattcattcacatgtgcaaataaaaggatctaatgccaaatgtgggcaaagcgacatacctcagtgtgagagagtaagtgctggaggctaagggcattgtggtctctccttcattttctcttatgaggcacactgatggggtacgtggacttaggacaagatggcacttcatctcgcttttctttctgcataccttgctcttagtcttctactaatgccacaatgaaaaaaacagaaacccccacttgacatctaaactctttaaaaacatgtaaaatttaaatcagtattatttattaaaaggttttttttaaattattatttggtaatgatttaccctaaaattttttgacttctcttcaaagcccagatgcttaaatattgcttactttgggtcttaatggttattccagagccatggaattttaaatttgatctcagatttttaagatgtgacagcttgattattttacaaggccaaaaccctgattcaagcctgcaattttaagaatcaaaactgttttcccattgatgaagacattttgaaatgtgtggtccatagctatttatgagtagtttacagctgttgtctctttgtgcccaagaccatggagaatccaggagccgatctgatcctcctgggactgctattaatatcactttcactttagacagctttgccttcaactagcaattttctggctcccttatactacattgtagcctcacagcattcaagcaggcacagggcacttggacaatttagcaataatctataatacagatttttgaaagaagcgatttgttcaaatgctgctaaaacagaaagtggctcttgaataccaaagtgggtgccagaaactgagaaaaaattccttaaactaggatctttagtataaggagaagtgattagaataatatcaatttggggcactgtgacatctgaaacataatggaacaattcctaattgttattgaggaagaaagcaagacctattaaggcaaaccaaccaactttcattgcacagggacataatttcggagatgctatatttgattccatgtttgatagggtctggcatatctcttcccaagtgtgctctggaaatcctatttcagtccttcttttaggggaagaagtcattacatcagccttgtaaagtacactggcatgcaaagtaaaatctgttactagggtgaaaagttggtacattctgtttttttgaggggaggtgagctctcacgtgcccccaacatgcacagttcactaaaaatctgtagctcaccaatctcctattgtatgcatttgttatttagtcttcagctctcctacattttctttgtttctttatctattaaacttttaaaaattgttccctgcctcttttccattctgattttaaaaattctgattaatatacaattgcatctgtattggcagaccatgtagatacagcatttgtaaattgcaagctatggagtacactgaataccatattaaggagttagtgaaaatgaaaagaactttaaaccctagccttttagatagatttctgcttttaaagattatctctggattgcaaaaacagacatgaatattgatagtgtaaacctgactaaaatatgactctaaaatatgaatgtctgccattataaaagaatctaatgataaaacctgaggaaataaacactaaaaaaaaaaaaaaaaaaaaaaggttgttttctcttccttaaaagtcctgaaatttaattttaccattctgtcacaggataaaacatctgtcctaatggaaaagtaacaaaaacccattttctgaaaagccccacagataatttttcacatgagtacatggaaatatctattccatttttggataactattctttcttgatgtaaaacactggtggtcaaaatatacaaatatcacatttgccttcaatcataaaactctgataagcacacaaattgcaataccatcatgctaaattaactaattcatttattaatcattttctttgaaagcagagtgacattcaggcactgggaatgctgaaataaaagattgaatccctgccttctggggtcttacacttcagcaaagaggtcacacatcaataattaatatatgatgtcacagatataaatacagaaatgaagtaaaaagagacaatgaatccagaccaaaagtttcaagaaaggctcctaagaagaggtgacatctgaatggagtctttgaagaccctgtaacaatagccaggcaaaggtgctctaggcaggaagaatgttttgtgcaaaagcagaggtgggtaaaacatgacttcagttctctcaaatagaattaatcaatctctttatacagtaactcagcacgttgtctgtacttctgttagcatgaatagaatgaatttttattgcttatctttcctggtggactgtagcctactagaagcaggctgatacatctttgtacctcccatttgtcttgcacttataacttgcctgcttagttttgatggaatgagccaatgaatgacagtaagatttcacaagagtcacctgtgaaacatacttcaccaaagcacccatggtagcacttattaacaaacggagtttaccagggatggggcagaagaaagtcttagcttttcaaagaatttcattcctgagacatttttgtggtcatgtatttaaaaaaaaagggttgggggggtgctctgagaaatgtgctctcagatggcacagctggaatgagagaaatgggaactgttttccattttacatagtttctggaaagggcaataagaacaaaaaaagcaacactgttggtcagcattctcagtgcctgagttgaaaggtgctataaacagagaaaagtctcataggccaactctatgcaggctatgtgccaagaatagctacaaagtggcaagttaaatcagccagggcttgtgagctgtctcaggacttgagtcccaacttgcactcgtgaaagttatgctgcaaagggagctacctttccccagcactgcctggggccttggcaagtctaatggagaatgagtttgatttcaagccctgctcccttcaggcaacttacaaagaaaagctgttaagtctgtggagctgggaatgtctggaaagagtgaagacccatcatttaaaactgatttctttttaaggaagtagagcagagagcagtgattacttcaacacccattctcaggggaatttctgtaagccggaatcagctaatgatggttaataaaggtaaatgttccctgattctcaggaagtgattcttcatcctggggctttttgaagactctgtcttcacttgaattttgggtggaataaagccctcctggatttatcctaatctaatactcaaagttggtagttcacaggagtctgtttattcttctagaaaagtataacagtggattagctactggcttctatcccttcagcacagctcccccacacaagagcgtacctttaatgactgatgctggtgtatcaaattgtgtcctctccttctaataacaaaataatgaaatacagtaaaatgccactttttctgactttttttttcttctaggacatgtatgtttcttacctcattcagaggcatgctgggaaatttaactaaatctgaaagaaaaacattctgtaaatccttaagactggattagtaataaggagtaatttctgatctggaataaaatccagaattcagcttgctcaccccagacacaaaacacaataaaaagaatggttgttacagttactaaacgaaggatcttttcacactcagcaagggtaaagactgtctcttctgtatctctgtattacccaagacattgagcatccatcttactgatacaaaggatgtctagtttgaaagtttgcctatgtacatttgtttacgcactcaggcatatacagactgccaactttattattacccaagattaaaaataaaaaatagaccttgctctcaagagatttcctttccgttaactgcaatgctaagtgagatgcatcagtttcatttttgcacgctcctttgctccgtttagtaccgaaataaaaacatgacgtagcttttggggccggggaggaatctcattcttgcaggaaataattgccaggaattttaaagagtgtcatcattttctctgtgtccagtcctgcccagtaacagagaacagctattaaaagtatccaaatgctggctgcaaggagaagttgaactctgaaccactataaacccaatcagatgcagacattcttcccatcccataccccggactcccagtgaatcttgaagaccctggggttagccttatcatttattcgtctgtatagtgatggcctgtgctaatgcccaaatgatcctgacttattaaaggttcttcctgaaaagacatgatttttattagttcaccacaacttattctcaaaaaagcatttattctttatcaagccacaaattttacttaattaactattctactagattccaagacgatttagaagctattgaggttgtaacaggataagagaacaactagtccactctgttaaaataaaataaaatccaaaaacattaaatgttttcctttttgttctctaatgagaggtagaggatgtgaaagtgaagatacagtaaggctagtgtttccaatgatttcatgacttctcttccagctatgctggtgtcatagtaagagcctgatgctattattatctctgattatttgataaacctgaaaaacaagttcaacaaatggtaaaacatctggatctttgacagacaatggcttataaaagagaataacgaacagttatttggagagtattaagacccagatggttcatcagggatcactttaaaggtgtttgttagatcctccctctcaaagacacctacacaagagtcatcagctgccaatagcactgagaagattttcacatacccagcactgtttttgtgacaaccctttccaaaattacgaaagaaaacaaaaacaaaggcaaagcacaaagaggaaaaatgaacattgcttaattttttcttgcacccagtgcttgaaacgcatcaaagtcagagctccatgctctttatctcagctcactgcagctgtcctttctgccaaaagcaaaacaactcattctctagaagaatctgaatgcccactatatccttgacagcgttcctaacaatagacgccgaagatagaacacggttagactttcattgacaagaaaggctggagaatagagaattgtgatcaggcagaagaaaaataaaaactggaacagtcagtggtctggcatatctactaccccccaccttttatttttctgaaaagcaaagctgtattttggcagagtccagaaaaactaggcttgtaattgttaatgtagttctagtggtttaggagaagcagtgggcttggccgtattatggaatgactctgcaaatatagctcagaccctaaggaggttaatttaaaaaacctatttcttatctgtataaagtcttgcacacgaattacattgtttccattttctccaaaagtgtgctttctctctctctagatatctgtatctatagatatagctatctataccaatatatctctataagttgtttatatctatatgccaatatctataacatatttctctctatatataaatatatagagacatctctgatctcgctatatatttagagaaatgttatagatattgacatatatatagatctctctatataaatatatatagatatatacatatatttatgtatgatatatgatatatacatacacatatatttatatagagagatctatatatctatatatctatatataaatgtatatctatagatatatatctatagatatgtatgtatacatacatatctagccaacaatatatatagacaacaatatctataacatctctatttatatatatgttgttatatatattgttatatatctatatatagatattttgttattacattatatatataaattaaattgaaagcttttggggaaaaacatatataaatataaatataaatatatatatacacacacacaatttctcattttttgttgcttggtcttattctaaattcctaagtgtagtctgccactctaatctcttttcccatgaagtttgtcttagaaatgtcatccgtgcaaacaacggctcaccaaggacaagtgctggtttatgcaattgagcagtagaggatgctgtatccacttcttcaagaggtaaaaggagctgatttctgcactcccagggatgagcaagcttcatattcatctgatggttatctgagcaggcactctcatgcattttgatactctagttttataaccagagaatgtcagagtcaataacatgattataagccttataagtcatagaatacagcctctcacacaatcatctttgaaaaatggtcagctggactccaggaacagagagatggcagcattgcttccttcaagagacatttattaagcttctggtagcaactctgtgaattgggtattattgtcctcattttacagatgaggaaatagaaacctgagaagatcgcagttagagacagacaaagtgggatttttaacctagggctgattccaaagcctttattttttgatcactacaatatacatctgacagacgttctctttaaccctttcaagactataagataagggttctttgtaaggacagacccatgctttcagtagtaaacactgtgtaaaagacaagagcatcataaactatggggctgatttaggcagccaatttctagtgttttctttttttgttgtttgtctggttctttcacattctctctctctttctcccatagtatagcaacaattggtctaaatattaagctttatctatgtcaccccacaaatgctgagtgtgattcatccaagtctataacaatggtagagtggcccattaccacagacagacaagaagaagatagcagtgtttacacatgagataatttggcttttctgctaagccttgtgtgccaagttaattactctcttggtgaaacaaggtattttgctcatataaggtagggaaacttgcagtgcttttggttttgttcatttctcttcactagtcattcataatgtggtttttaacaacaaaataattagttaactgagatagaaatgaaaatcacactggtccctgtgcataaaaaatatatattatagatagaactttgtgcttgccatttctttctttcatgttgtttaataacagagtattttgcctgaagttccttatatgatcttctgattagagaataactgccaaaatgatgtttgaaatgcaagtagtatggcagaaaactcttaagaggaaaatgttaggaccagggcaagtgctccctaggagccagagttcagaactctgggctggttctctgtgctagttactgctcagtacccagtgcctagaatagtgtctagtacacgacagacagtagtagctaatagatgtctgtccagtcaatgaatataattccctactctggtgcctgctgcagcttccagaggtggactctttcattcaaactatttttactccattttatcttcaagagaagaggcttcactatagggataaccccaggttcacaggaaggcatcttctgttcagctgttccttattcaagcttccatactgtcatctatacaacaaatcagaccaggatatgaaagacagagggcacctcctctaggttgccattgccttaagaccatttattttgagaggtaaccatgcttgagacatgcttatgttaagactactacatgaattttatttaaaatgcaatccctgattgtagaagacagttttgtgaccagtgaactccgtggatcagcctttgatggacaaagagaaaagacttggcttcaccttaacgactggtctgtaagataggaagtttaagttctaaggcaactggactaaaggccagcttaagaaacaaagcaaaccccttacactggtgtttctgttccactgatgactttctccatggtccggagctgatggacagctatattcacacacactcttcacaaccattctgaaagtaattttcagctgcaaccaaacaaccagggacctactgtgtgacacatggagcaattgataataccagtgctctatggatcatgttgtcttatacatcacatgtgcttgattggtctgatcaaagttatgattgaaccagctctgcacctgtattcgtccttgcacgttcaagtgaaagatgatgcaaccacgacaggctggaatcaggcctttgggccatctgagtgcaatttgagacatggagttaggctttaagaatgactttgagggttctcaagtaatatccaccctctttcacaggagtaacaggtcacctacctcccatgaaaggaatttaaaacaatttggaactcagtaagcaatgttacactcagcttgtctgtctggcagagaacactaaaaaaatatgtaagactcatcatgttaccagtctgtcagtaaatatttaccaccttgagacaaaagtataatattcagcatttgatgtctaaattagtagaaaagacaaacacaaatataataattagagaacaatacaagcaagtttaggtgtagaattcagtggctggttgagatgtcagtgaatcaacagcttagaaaacagctgtgtttccaaaatatgttggcagcagtctatacgtgttctcagtgatgtaataggagtcaggcactcacagaagctgacattatccataatgaccctgaatcatagacttcagcatgcaaactcatgatgttctattgttccaataagaataatatctgggatgccagacatacacctgcccaaagctccctgcagaaggcaatccaattcctcattctttcagcggacttggcagaggaatgatgtgtgtgtgtgtgtgtgtgtgtgtgtgtgtgtgtgtgcatgcagggacaagggggcatcttagctcaagcttaccatactgggaggacagggccatgaaggctggagtgaggaacaggggaggatgagggatagggactcagggatgggaaactggcatggggctctgcaagcagtgataatgaagagacatcctggtcctagagggcagagaggaagcgtgggaactgaaggcatttttccctttgctctgctgcttgtcactcacaacaccctgcctcaccaaaccccagctctgatcagggctcctgcagggattctggaaagaggaagaacacgcacgttatgagactttgatgggtattgtcctgaagcaaccaggaaaataaaaagaagtaaattttagtgtgaaagcagctcctggtcctttggcttggaaaccacttctgctttccccttctgctgtcctgatcctcactgcttccctgcagactctgcaaaccttgcatactgcttcaggcaagagggtctgttctggtaatacaagtgccttggggtttgcattcatgatagtgttttcatgaattttcatctaaaaacaaataatagaccccctcaagaattgttcctaggatttcacacatatgacctgaaactttaaaatcaacttttcacctgctgtttttatttagcagaatcacattttaggaaagctaatcatttgctatttaaaaatctgaaatagagataaggttttacaataggcttcagagggaatacttgctcaactaaaggaaaagagaaatggcaggagttccaccagggatgatctggcttcagtgcaacctcatcagtgtgagatattcttgctggtcatggcttggctaatattctccccagcccctactcctctcccctccacttctacctcagctgaaacacccaagttgaggaaaacttcacagggagaataacccctgtgttgtgctgcagccagttcatcctgggagtcagttatgtatacctctccccagttctgtgtttagtgacttcatgttggtggctagaaatcatccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatatatgatttttttttttttttggtagagatgggatctcataatgttgcctgggctggtctcaatctcctagcctcaagtgatcctcccaacttggcctcccaaaatgtcagtatgttgggattaggcgtgagccactgggccaaaatgaccatatcttttgactggacaatattatcctatgttctataaaccatattagtttcagaactaaatgtaatgctaaaatacgatgactgattcttttttttttcagtcaaatgtattataaaacttttacgcaatatcattttccccctttggggaaagtagagggatataagctacaaaagaataaaaaagtaggtagattaaccaaatcctgttttttttaaaaaataagttactttgacagagtctgctgaaaaatattgttaaactatttgtaataatatttctggtctggttagaaaatttattagtttatagtacaatgcaaagggaaaaaatccaacttctctattcaggttacaaatgtgatttcacatttgggagttgtgagagaaacgaaaagaaaccttaacaactttcttgccagattgctttgaatccctaaatgccttattttgtagccagccattggaattgagctactgtctccagacaatcccattaaatatatattggttccctagaaaggtaacaaaaaaaagttattaaaaaaagaggaaacagcccagtgcagtggctcatggctgtaatcccaacactttgggaggctgaggcgggcagatcacttgaggtcaggagttggagaccagcctggccaacatggtgaaaccctgtctctactaaaattataaaaattagaggggcttggtggtgcttggtggtgcatgcctgtaatcccagctactcaggaggggaggaagggagaattgcttgaacttaggaggtggaggttgcagtgagccgagatcgtgccactgcattccagcttaggcgacagagcgagactcagtctcaaaaattaaattaaattaaattaaattaaattaaaaaataaggaggaaaaaatgatgagattagcagacaggaatgggagatgaggaagtagattagaagacaaacatattttttaggtagttggtgctaggagaagtcttgagcaagtgtttcattggataattaaaaggcctgtaatagtgaacttaaaatgacataagtcaatttggcagggaaaggaaggaggaggagtttttgcttattatttagtctcaggttggactgccacctaaactgttggttccattaagtcaaggagaccccatatcctcttcattactgtgccttgcaaggtgcctggatgaaatgaaagtgaaagaatgggaaacgcagtacgaaaggcaaataactgcagctgaaaaaaaaaaaaggtttctttgtttctttgtttttatcttggtttagtagtttcaggcaaattctgtatcttctagttgacccatatatagcactgattctcacaaagttcggagatagcattagattttaaacttcattttctttgcacaacaatttattcatccccttctatagaatatatgcttctagagaagcaggtgcattgtctcaaagaaaaagacggcagcagagtctgggccagatttaccataatgtgcgtcctgggagatcttgctgctgtcacatttgcctggttaactatccataagtccatgttaaatactcaaaaagagaattacagtgaagaaaaatggatattttaaaaacagtggtatctttttttggatccagaaaacaaaaagtattttatttgccagaggtaattttatgtgttagtcaacaggatttgaaggatcctaaaatacccattactacagctataataatgagtaataacaactttcttctctttatttcttagatgtttggaagtcctatatgcatatcccatatggatatttcagtctatataggtatatccctgtcttcccttttgatacataccagttaaaaaactgaacagaaagtttcaagcaaattggttaaactctaatggattcctctggcaactttgatgaaaaggtttatgcctatgacagaaaagtcccatcagtgggcaaactttctagacataaaaattcaatgtaatctacagcaggtaaattttatgtcaattgaacatcaggattggaatttctggtaggtgtctagtgatcatagtacaaactatagttttatttataagggaactggatgtaggcgacttctttcagtcttcttatcacaatctttctaagaagacccttcttttcagtcatgaagaagctttgtgctgttgattattaggagtattttctcaaacaaactttccagtctaaaatgtcaagccacagatgaatattgagaaggcttgtccaaagtgttcaatcagtgattttgagtttatggaagtcactggtatgatgacacagctttatagctgagtttctcactgtgttcataaaataaacaatttaaaaagtaaatcaatgctttgcatcaacaatagaaagataagttcccctgctcatattccgaaagtttcctaggtttcaagctgggagttccttgaaaaagcccagggcgccaacagcatgatgtgatccgctcccatttttagatgagtcactaggacagttttactcaaagaggcaggggtttgtggaaagaggagtggacctctataaatggcataatttgaatgtgcattttgaaaatgccacatgagcaaacttgcccacctgccagtccagagaagtactgctaaaatcacctctgaaagaaccacatgatctcaaatatttaaagaataacttccaatgtctctcaatgcaccttttgttattttatgttagtgcatttatccattggatttttcagttaatataaacatttttatcatattttcattagatgagctaaaatggatgtactcttaaatttcactgcgaggttgaagtcatattcagtcacaacaccctgagtgctggacaagacatctttactttttttttttttttttaacaccacgagctctaaatccttccaagatacaaaccattaaaagcacctttataatcaacgtatgtcagagatctaacatcatattaacttctagcacatgcaggtagctaattattattttatttctagtctttacaagtacatggtcagttaaatagaaaccacataaagagtattacaagtggtacagtggaaagaaattttaaaaagagggaggaaaaactaaaccatgagaccaatatacagggttcttctctttctatgacatatgtgctctcattagggcattgacaaaagaaaatatatttttcagaacttttgtacccctgatgctaatgtacacaagagaagccatcaaaagcctactgctgacaagtcagactattgatccatcctgtctctcatgatttcccctgcctcataatttgatggccttttggaggcgtggacaatgaaactgccaaacaaacagggactctcacatagagctttgggctttgtctccagtgtctaagctagatttttgggttatgctgctgtggaacagctgcttccagagtcacccctctagagacatacttggtcacctgccaggatttacatgattatccatcatggggacaaatctatcccaggaaggctcatttcagaatataatacagtgtggattgaagacctaatggagagaagtgcacccacaggagtgactgtgatctattaaatcagtaagaccttggaagccttctgtcaactgacttcagaaaataatggttcccctctcaacacaccactgtacttttttatttgtcttttgttaagtcatcctgaggaaaaggctgctggactgggagatttaagactttgaatagtgctaacagaatagaaaaggaaagttaaattacgctgcctattctcttaccaaactctgtaataacaacatctattccttcatctagtgaactgtcaggtagggcatagagaatacgcatttggaaattgatctcaactgcctttgagaaaccatagatcatgggaaaagaggacctgtgtgcctttccatcttaactctggatcactctgctcctcatttcagaggccttctttcccttcttagagtagatcttattttgttgttgttgttttctgccagaaaatctttacacatgctgtttcttcttccttggaatgcttttcctccactgttcatttgcctgaacacctaagttaactcaggatcctcctattcaatgtctattgacctcgttaatttttatagcattttctcacaatctgcatttgtacttttggttcatctaaaagtctcacaaaggcatgaaagcctcacaaaggcagggaacatggatgctaacatgaagtaggagttacataaatatttgtcatattaaagaattttaaaaaataaaagtaaataaatgaagactgcaaaaaattgacagccataactctggattgtaaataaagttgtatattgatgctgctgtgtccagttaaataaaccttaatctaaacttggagctttagagtttgtatactagtcactggaagtttcaatcattcatgttttaaatcacatttttctcaataggagcatatcctttaggtaaaatttaaacattgctctcttcccttaatatgagggacttaatatctagctttacagggctttttaagagcaaggaaaatcactctattgatgctaagtgaagggcagagaaagcaactctattaagcttttgacctagtttctctctggttacttcaaggcaattgaaaagtcctcgattaggtgcaatttgctagtgactattctactgctatcagtgcagaggcatatagatggaatagggtatgtagacttatctatggtatattcatttacataattttatgtcataaaaaacaaaaaaaatcaaacttgtaacattactgagtcagtcgtaaaacagagtatccagatgttattttagaaacagcattgattgggcgcaaagatcaaggtgtatatggcagctttagtgagtttggagtatagaaagtgttgggatcaacagaatccatagcaatcagtttaaagttttcaataaagctatgaatggtaagagggaaaccaactagaatttgctgctcattcacctcaaactgcactgagatatctttatgctcaaaatggacaaggagactattatgtgtattctttgatgcagcaatgctacttctaagagtttatcttacagataaagtttcacaagtgcataaagatttttaatgcagcatcatttttttaagttggaaacaacttaatgtccatcatttgaggttccttttttcctatcatattgattatttgctatctgccaggaactgttctaaagcacttttcacataataactcaatttgtcttcaaaacaacaacaatcttcagttactttccctactttaaagataaggtaaagtaagttgtaggggaccacagaggtatttagtggctaagctagggtttgaattcagacagccattaaaaaatgaagtagacccaaacttactgataaaacacctagggcatatttttaggttgaataaaaaagcaagttgcatatatatatatggggagagagagggagagagagagggatacattccttacaaaggtctagaagaatctgttcaaccaagcgtagtcacctcttgcttataagcagatgcttgaagagaactttccccttttactctttaaaaaacatctcaatcattttaattttatatccttaaatgttaaaaagttatgtatgcctggttttataaaataaagttaaatgcaatttcacccccactttaaaaacaataactaaaaaggtatagcgcttactgttcataattttgtttcctaacaattaaaacatgttattaaggaattcaatttaatatggtctatagtcacatgtacgtataatctgtatgtagcacatataaagttctgaatagatggcttccaccggggtgacaaaaggaacagaaaaaagttatactatgttaagttcagaactttacccaaatatctttagacacacagcataatacatgagaaaaatgataactacagataatccataaagttgtttaataaagaatggattgaaaagttatttaagaaacaattattattttttttttttgatgcaaggtctcactctgtcactcaggctagagtgcagtggtgcaatcatggctcactgcagtctcaaactcttgggctcaagtgatcctccagcctcagcctctggagtagctgggactacaggcataagccaccatgcccagctaattttaaaaaattattttgtagagcctgggtcttgctatgtttcccaggctagtttcaaactcctgggctcaacagatccttccgcctcagcctcccacagtgttgagattataggagtgagccaccatgccctgccaaaaaagtaacatattgaatgtaaaaatcataataaaagttataatgatttggtgtatactatgtcattctaaaataatttgtgcatttccttctaaatatctatctataaacattagtaaagaagtgggaaatttttttgtcctgaaattcattttacttaattagcatcatacagaaagtcatttatgtgccagatgctaaaagggaggattacgatccagcagatattgatcataagaatgaaatgaggcacaagaaacacctgtgaatcatgaagtattgacgctggattttattaactcctatatagtgataatgtgattgaaagattatgaatcctataaaggaaatatatttaacaagtccctactaacaccaactcttgactctcagaccatccacaaataatctacaattagaattcattatgtctaaagacagctatcattaaaactgaaggccaaaatcgccctttctgcgtacttctgaaagagcttgcctttgtgagcaggaggagaagggaagagagacagtgtacccaaggaaaggagggtgttggtggtatagagagaaaggcatttctagcgcccaggcaccacaatgagaatttgagaattgtgtttattgtctatagagcttgttattgctcttgggtttttggctacaaaacctaataatttactcagttttgcaaggaaataagaaatgggcctcaattcactctccttaattcatttagttggatctgatttgcaatgtatgttagtactccttctgtagcaactgaaacatattaaaaatgactctagaaaaaatacatgctagaaagtgcttcggttactttttccttaactaggagaccccaagagggaaatgactaggtctcaaaatttctaggaatgacatttccttcttctgagcaacttgaaggtgctacagaccaatggaatataagggattcattatttaatgtacaaaattcaggctgctgctttagggcaaacagaaaaaagtcaaaatttgcctctatatagaaggctaaaaacacttttaagaaataaagtaagtcatagggaactgggcataattgaagttcccaaagccaaaattttcccttttttatttgtaatccaatttgtggtacaattttcctaaatcctacttctgattatttttaaatttttctttataccaaataaaacaaagttaaagacagaactctgctaaaattttcaatgtaaataaaaattaaatcatttaataaattatattagttgtcatgctatattttatgtttactcttgttatgttttatttattttatgtttgactaatcccccatcctgtgggaaacgtttgttgatgctgaaattgccatgagctatctttgctctatttcctttacttatgtcatcatcaagttcaccaattaacctatattttcacccaggtagttgacaaagcattggatgcacctagccaaggactgttctatggctctccactagaaactccctctagaccaggctgatgtcaagccatacacattaatgataatggtaatgagctacataatccagccctccttgacctcatatttctacatctgggtcatgtgactataattaattttttttttcttacatgtcttggtgaactgaaggcacatgatactcatggtattctcctgatcttaccactaggcactgtgtcaaaagacatagaaattgaaactgggttccttgagagcagacattatatcctattcatcccttaattctgtttcaaaaccagtgactgcaagacacagaaatacatgttcaataataaatatgtaatacataaatacatgttcataaactattgggagagtctcaggattttgaaaaagttgttttgtagtcctagctatgccactttcttgctctgtgactctggacacatttcatagtctccaagaacctgagttctaaatctgaaacaaaaatgtactgacacattttaagattctctttcaggcataaaatcctacctagatttatcatttccactgtgtaacaaagtgggacgatgacccattttttgtaactcagtagttttctggaaaaaatttaaaatgcattttttcagtacatcaatacatcttgagataaaacattgtatagtctctactttgtgtaaagcaaacattttcattacttatctaaagacttaaccttctttataccaatcatctgtaagtttggaaaaacaatgcaattgaatttttcatccagctgtttaccatacataacttagaaatcctaaaatgccttattgaaagtgcagtgattttagcattggtagagtaacagtctcaagaaatgaatgaagctttaatgactcatcttcaattcaagaggaggggctactattataaaatgttaagctgaaaaattccaaacacaactgagatgaagttacatgatttaacaatctgttttttgtttttttgaaataaagtctcactgtgtcgcccaggctggagtgcagtggtgcgatctcggctcactgcaacctccatctcctgcgttcaaaccgttcttctgcctcagactcctgagtagctaggattacaggtgtgcaccaccactcctggcaattttttttgtgattttagtagagacagaatttcaccatcttggccaggctggtctcgaactcctgaactcagatgattcacccacctcagcctcccaaagtgttgggattacaggtgtgagccaccatgcctggtctgtacatcctaaaaaaccccagtgttctttctgctgactgaggctaattagtgtgggtgataaaaattgggcacacatatcaaacacaaattggctactttgtccagcaaactgcttccaccaaaactccggctagcaatcacattacaatgactacttggctcttttctttccctaaatggatttggttatagaattggaaaaccgggtatactttgttttcaacagattaaatgtaatgggttttatgaagacagtctttatattttcctataaaaaaggtaattagttaagggattttgggggtaggagaatgaggcacacaggggagtactcatttcaggaaaaataatacgtaacaaaatattcacaaatattctgctgtccctcaagctgatgaattaatcttctcgattagttccagataaatcctaccatttaatctattttgaaagaaattagaaggctatggttttaacactatgttcaagttttcgctaacttgtaaaatggtaacatacgtgctgtaaggatgacataagagatggtaaaggaaagcatgcagaaaactgtaaaagcttataggattttaaatataattgtacagtaactaatgatggtgaaataaaatagatgttccttgatttagaacttatggatgtttctgaagactacatagaataaacaatttagatgttcacactctggccttggccttatcaattcgccttcccctccttgctgaccccacccctttaatctaactccccccaaaagtggccacatactgggagtaaagagagtggcaatgaacctggatctacttggggaggaggcctcggctattcaaagagtaagaaaaacacaatgttccaggctcctgattctcaagcaacacagttacttggggtatttctcaccaagtgacctggatttgaggttggcaagtgtcgcacaccccacctttctgggtggcagagccatgtgaggctgttgggctgcacctaccagctaatggctctgtgactctgtgtcacaaaccatttgtttctacatctcctggcatcaggatccaggaaagatgtccacactcattatccataaagggagttgattgcctaagtgatctgcctgcattctacagagtggagaaaaacttattaaagataggtttagtcacaagattgcactgtcagcagtcagactctcctcctttcttgacttttctttccctcatgctctaatagaattgtggctgaactcatctcctacttggattatttgtcttgagttgaaggagccctggaagatctgttctgaaactggatgtgacgttaggaaggcaaaggagatttaaagtgacaaattgctggctcaattctcaggaagaggtgctgcagaggtgatgtgcaaacatttggacttgtaagggtgatgatccaggaatctggggactgggttctttgcctaaatcctcccccaccttcaatgccattgctctatgctacacctgcaacagcttcccatctgcctctgcccaaatagcctccaaagtggaaatgcagttcggtgaaagagagtttcagcataataatccctgggcctttttctatacttaggacagaaacaaagtgaattgccaaggagcagacctctctccctactaatcggtttagagttgtgttgacaaaatagtggcaaaatctccagaagaatctccctatgagcctccctgagcctcccaaactcctgcatcccatgcatgcatagatatctctatcacattcctggcttttgggaaaggaattgcgcatacagcaccaatacttccaaagtatttagaccttcaggctatcactgtcctcaaagtttcaggttccttatccataaaattctgaaactgggccacaggatcttctaagtctgccaacccagccctgagggcccatgaagatctatgctgcttgctttggtgacaaaaataaaaataaaaaacaacagttggggcttgattccccatattaaatatatgccaagtatatactaagtatatgttaagtacaatgctaagtattatcttgttccattcttactgcaatcctataaagtcattcttgttatcacacccatctgacagatgagaaagcagatctagacaggtcacatacctaatacaaggtcatgtgactagcaaactgtggagccaggatgtgcttcactgctttagaagttcgagtgtttaaaatccagaatgttccattccataaaaaaaaagacattctacatttcttatttgtttcgtaggctggcccacaaaaacaaagtattgtttcgtgcctcagcgtaagtctgaaacaagacatgcatggtaaactagtttcttgagccccactgtgcccttctgaccccaggaattctccacagttcaaacctcagactcatgctctgaggcttcaatttcaccacagactagaacttgagctcagattttggagaccagaaacctagcccttctggccctaagaatgacaagcctctccaggagcaaagtcaggaaaaggctgaagacaccagcagccgttgagaaattaatcgagctgcagcagtcattttgctttatagggtatcttttttggcagaatgatcttaaaaatccaggacaaagtatttaaccaaatatgtagagcaaagaactgtgatgagttaccaacacatttctcacactagtaggttaagatgatttacttgatatttagtaataatctatacgtaattgtcctttttatgaggatagggatatttcaaggtgaaaagaggtaagaaaatgtggttgatccctacaattttttggatatagaggaagaaaaacgttcaaggaagttcagagggctgaagataggtggtcttcagctttgcatcttgatttttgcactaactagctccatgacctgggataaaaacaatgataaaaatagtgataataaccttcattcactgaattctatgtgctgagaatttgctaagtgctctatatgtattatttcctttaagatttaaaacaacactataaactggatgttataagtcccatcttagacataaagaaactgaagttgaagttgtgataacttgtccaaggccacaaagctgttagtggctaagttagtattagaacataaatatgaatccaaaacttatcccaactgaatctgaactgattaccttcaggctataactgtcttcaaagtttcaggtttggaaaagcctggagggaactggagactattattctaagggaagtaactcaggaatagaaaaccaaagatcatatgttctcactcataaatgggagctaagctatgaggatgcaaaggcataaaaatgatacaatggattttggggacttggagggaagggtgggagggaagtgagggataaaagactacaaattggggctgggtgcggtggcttacgcctataatcccagcacattgggaggctaaggcaggtggatcacttgaggtccagatatggaaagttccttatccataaaattcttttttaaatttttcatttccataggttttggggaaaacaggtggtacttggtttcatgagtaagttctttagtggtgatttgtgagattttggtgtgcccatcacccaagcagtatatatactgaaccccaatttttttttgagatggagtcttgctctattgcccacgctggagtgcagtggcacaatcgcagctcactgcaacctctgactcctgggttcaagcaattctcctgcctcagcctgcaaagtagctggtattacaggcacctgccaccacaccgggctaatctgtgtgtgtgtgtgtgtgtgtgtgtgtgtgtgtgtgtgtgtgtttagtagagaaggggtttcgccgtgatggccaggctagtcttgaactcctgatctcaagtgatccacctgccttagcctcccagtgtgctgggattacaggtgtgagccactgcacccagccccaatttgtagtcttttatccctcacttccctcctacccttccctccaagtccctaaaatccattgtatcatttttatgcctttgcatcctcatagcttagctcccatttatgagtgagaacatatgatctttggttttctattcctgagttacttcccttagaataatagtctccagttccctccaggttgctgcaaatgccattaattcattcctttttatggctgggtagtattccattgtgtgtgtgtgtgtgtgtgtgtgtgtgtatacacacatatatatgatacatatatatcatatatgtgtgtgtatacatatataacatatatatttacacacatatcatatatatgtatatatatctgtataacatatatatcatatatatacatatgtatgatatatatatatataaaacaatttctttatgcacttgttgactgagggcatttgggctgattctatgtttttgcagttgcaaattgtgctgctataaacatgcatgtgcaagtatcttttttctgtaatgacttcttttcctctgggaaaatacccaggagtggaattactggatcaaatggtagttccacttttagttatttaaggaatctccacactgttttccacagtggttgtactcatacattccccccagcagtgaagaagtgttcccttccaaaccacaatgtgataccaccttactcctgcaagaatggccttatccataacattctaaaactaggccacaggatcttgtaagtctgtcaagcaagccctgggagcccatggagatctaaacatttagaagagggaaaaccaatgagacattttcaattcttcctttcttgtagactgtaagcactagcaaaatgaattgaatctgtatacagttactacacactgccaaaatctgattcattttggataagtgatgatttccagaagtacaattctcagctgaccatacgctgctatgttcattcaatttaaaaaccttgagccattctaggttttgaagtccctcaccctgccttgccacacccctgtagcaggaaagaagctttcccaaagaggaggagattttacttcaagagttattacccgcttagttgcacacacattcatcacattctgagcctgattggtggctagagttctcagggggccagcactggctggggaaagtggaaggaagagatatattttaggcacccattgatagctttgctacaaaatgcactacccgggcacaacacactgagttctggcaagtacagcccatgttaaagacaaaatactccactaacttgactttgtctttcttggaccatctcaaatttggggaacctctaggtatctgattgcatatgttcctgtgtgctcctaaaggtgccaggggaagagaaaaacacatggcaatcagttgacttgcaaggcctagttataagccgaaataaagttttaggtacaatccagatgtataatttgctataaaaatggactcggaggaatccttggtgatttcccacaagactgagccactgtcctcctttcaatacgagggggattctgggttttccagacctcactttcttcaggtctgagataagcctgagacatacacaattgctgaaggtaacgtgaagcaggaaaaggaaggccagttgctctattaaaggagcttgtgttttcctctaaccaccacagtctgggcagcagacaattctcctttttctttcagagcaagtaaaatgttctaggtcatgtttaggttgtgacaggcacccggatcaacaagacgtcatttaccaagataagctggaggtcaacatctccttatgaaagggctccaggagctgttgcataaatgcaaaataacagatgcacaatatttgagtcctttagtatatctcataaactttaataatgtgataatattcaaacacatggtagtgttttaatggtaactacagaagagcccctggaaaatctgacaaatgctgtcataactggcccttcagagatgtccttccagctagtccatatttgcccttttaattagagttttagtccacttgttccttcttgaaggaaataaggaggctgttggaatagcaattttcaatatccagattccagacacatcaccctgttatagacagaactcaaatccaaggcatttctggaatccctatgttaattaccacattatcaagtcctggaaggactgtcgcataaggattctgagtaacttgattctcctaatgaacctgagccacccagacgatggaatgaacagcctgtagccagtctgggctgctgcctctcacccccgcagtctcagagctttggcctctcctgggtttggcacatggcctgtcctttcccattgtcagcctccttttcagcgcggtttggcatcctcttcaacatgaactgcctagagtctcgtcgtgccccttttcttgacccagccactgcctcatgtgctgccgtgtctgctcactgatcacctccactgtcttctaatctgttggtactgcattgttttacctgggtttgcaactggggctctgagatccccaacgctagctgttttctgggctcagcgatgctcacctagacctcatgcgcccgccagagatgaacccaggtggaatccctttgcctatttttgtcaggtgaacatggacttccgcttttgagaatcttccacctacccaccccatccatttgacactaacatgtttaggtcagtgcttctaaactttagagtgcatctgcatcacttaagaattttgttaaaatgaggattctgactcagtaggtctggtgtggggcttcaaattctgcatttctaacaacttcccaggtgatagccattctgctggtccatggattgcatttgagtagcaaggctctaggaaacagccttgtcctattcatctttgctggcctgcaatttccacagcagtttcactgccaccacttgggaagccccttctagtggtgtgaagcagtgaagacagaaggatgaccatgacacagtccctgctccccagggttcatagcctggagcagttttcgagttcagcactggatgttgagggctgataatatttagttgtgagggaagtcaggtgaaatgtaggttatttagcagcatccctaacctctacccactaggtatcaatagcatcttcccagttttgacaatcaaaagtgtctctagacattgccagatagttaagaatcaccggtatagggagggagacaaatatataaattaataactgagaggatggatcaagttatagaagctatgtatacactattcaggaaaagggattattaatatttcagaggctgtgataagcatttgacacagtgtgtgctcaataagtttgttagatacacaaatgcactgtgatgtccccacacttcctataacagtttacctttctgactgtctaatagaaaagacagttttacattccaaagattagcatctacttcactgacataattcactttcatggacatgtttgccaagtgtattacaagagaaagaagcctccttattttttaggataatgaagatagagtatagacatttgtaagaaaataagacacttaaaataaatatattttgtgaaacagaccgtttgtactgcttttttgacattatatgcacattcctatcagacaacaactaagaggagcattgtacatattacttggtaaatgaattcaagcaggatggtgcattttgttgcttggcacatcttaaatgcatgctcctaagcagctgtttcttttcccttacaggttttgggaggatgaatgtatttccaaggaactgtctattctgggatgctcatgctcttatacagatgcatttgacatctcaccatgcatacatagaaaggcaaaccagtaagcagataagcttggggaacccaaataagaggaaaaccagtgagcatccacatttatgaaatggaaaggagatgaggaatgctcatgtcgagcagcagctctaaatctcagccccaaatggcagagctgagaaaagaaataatgtcagcattggacttacataacaagatggcaagttgaagattttttggttatttatcttaatatagaggcaggaattgagaagggtctgactttgaggcagaacaaaagggctgtgagaatactgaaggtgtaagggcatttaaggataaataaaaaaaggaatggttgtgggggggggcatagcgtggaatatttcagtgcaaactttcagacatgtacttggtaaatgttattatcccttaacattttataaatggaatccaaaataggccaatgggaaacattcttggaaatatataccaactggacaagaatattcacagttgccaaaggaaagtgtgacacttggttctcgtgccaaagtcaacaagcctttgcccaaataatggcaaatcttttcgtttggaacacagtttcttaattaagccccaatgtcaattactgcacgtaagtagaaatcagcagatctgaagtcaaggccaggctccacggctggttggccaggtgaagtaacatttgtgctccaattttcctatccagggaatggggaaggtaatactttccaccaatctatgctgaaggaatattgtgatgagtcagagaataaatctctgattttttttgtttgcttaatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaaaaaaggaagaaatccctgtcacatggtacacggttgaactttggagacattgtgctaagtgaaacatagtagtcacataaaggcaagtatgattgcatgatatgaagtatctgaagtagtaaaattaatagaaagcaaaatggtagttatcaggggctgggagaaggggaaaaggggagttgtttaatgggtacagtgttttaattttgtaagacaaaaaagttctggagatctgttccgcaatgatgtgaatatacttaacactattgaactgtacacttaagatggtcaggatagtaaattttatattttttactacaatgaagtttttaaaaagatataaataattcagcgaaaggaaacaaaagcctcaaaataacatcccattttggttttagcattagaatttggctaaaggggtacagtctctgatgagacttctttacataagtagccaagctcctggttaccagaggtgtgtctggtcagtaacacactttgttcacagacaggaaccaagagtgcaagtgtcccccattctatctagtttgtgcctttcaatggcataggatagcagcaaaggcatcataaccttccagggggaaatggatagttagtacttaattctatgtaggctgccctatacaggaagcactgatttttgatcatgtaacattctaaatagccacaaatgaaaataattgccagttctgcatcatgaagagcaggagaagaagacctgctaaaagagtcagaaaaataaataaataaatgaaatactgagataatatgaaatggaatgaaataaaataatataaataaaagtaaacaaacacttttcaagcaagttttgtttctcaagcctaagaaaccccattttggcccaatatacagactactagagaatttcttgtccttaaagcaccaagtgcttagtgtggcatctgctttttgctaatttctgaggagaaggtgcctcatgattcgtggcagtgacattatctttcctattatgaataaaaaaccttgaatcaaattggagtgatataaacttaataggatagagccttcagatctgcattctcagccaatcactactttactgggttatcctgggcaaaactgtacttcatttgttttttctgcaaaggtagacacttttcagatctgattcgagggacagcaaaggtggagtagaaaggtcactggatatgctgatacaacatgctacagaaagtaaccaaagacttcgtggtttgagggaacctgggccatttctgctaggcagtaaatgacaggaagaagcttggaaggttttctcttaagtgatgtttaaggctctgagctaccaagacttctgggaatcaccaccaatatcatagtgctatactttactcagtaagcagaaggaatttctctgttggaaaaaaaaatcaaacaaaataaaaacaaacctctaaaggtgtattgggctcgcagttatttccaataggggctcagtcctatgggggaaagggagtcaggtagacgccatggagatcagacacctggctgattagctccactgagaacgctgcaaagggcaaaactttgtcatcccatctctttgtagaagcatcttctctggaggcttttaaaaataggacttgctctcagcatttagagaagacagagcataaatcttcctggggaggagtggaagaaataaccttgcaaaatatttgggggactgggtcctgtggacagttggtctccatagttaactggagatgttgaaattgcattcatgcaacctaaaatgcttagacatggtgaaataactagttgaaccaattattttgcagtgaaaaaaaaagcttcaccagtgaaatccaacctgttttgttattgttgatgtttcattatttttactgcatttagcttttgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctagggaaagagtgcttcaggctttggaaggcgcacagataaaaaggatacgtgtttttggctggagctacctgattctatgatctccctaaaattggttactgaaatattctcaaatgtctaagcaggtcatattgtgtaaatgaatgatctcctgaatattttacttttttttttttttttttttgtgagacggagtctcgctctgttgcccaggctggagtgcaatggtgcaatcttggctgaccataatttctgctcccaggttcaagagattctcctgcctcaccctcccaagtagctgggactacaggtgtgtgccaccatgcccagctaatttttgtattttcagtagagacagggtttcactatgttggccaggctggtctcaaactcctgacctcatgatccgcccgccttggcctcccaaagtgctgggattacaggcgtgagctatcgttcccatcctaaccattttttattgatatataatttacatataataaaatccaacatgtttaaagtgtataattcagtggtttttagtatattcataaggttgtgcaaccatcaccattctctaattccagaacattgtattcagccccaaaagaaaccctgtaccaataaccattcactcctgctttcccttcccctcagcccctggcaatcactagcctactttttatttctgattatttcatataaatggaatcatacaatatgtcaccttttgtgtttggcttctttcacccagcagaatgttttcaagtttattcatgtcatacatgtatctgtactaacatcttccaagtaattactgtgtccaaggtaatgaggtgttgaagcttttcttttcttccagatgtatggagttggtgcagacccagtccagtcttatgacgagccttggatgccatggtcacaggcagcacatttacggtgtagccctaagggttatgggaaacccaagtagttgggttaacccagtgagacatgaaaaactgcccagaacacaagcaagaaacaggtcataattgagaattgaggaaagaaagtgcaagacaaaggtgttcagatacacagttaagatctgagtcctgggtcaggacagaatcaattaagagagaaagaacagtgggtgagaagaggtcagtggccagggatgtacaccaagcagccaaggatctgtagtactcgggtctgtagcagctgccctgactcaggccatgtgacttcagagttctctgtcacagaagcatagaatatttgcactggagaaaaatttagagctatattctttagcaccatggttttgaagatgaacaatctgagctctagaggggctaagagacctcccctcaagctcaccaaccttagtgatcacttccttcatctccctccactcagtagaatacattttccacaatagctcactgccatgggaccacggcatgggatcccaacagatggatctggtcatatgttagtgccaaaatgcagtttagcaaccatttactcacatacccttatactatgtgacaatcagcagaaggtcttagatatttttatattagcttaaaagaaaagtttgatgttctttgacctaatttttattggtttaattgtctaaatacctggagttcctttacattttaaataaatttaatagtatcaatctataggtttagaaactgagagaaataatttttattggttaattgtctaaacacctggggttcctttacattttaagtacattaatagattagtatcaatctataggtttaagaactgaaagaaatgaatgaggtccccaacacgtcagtcaatgggaattagaacagtgatgcccaaaatatgcacataaatatcacgtgatgaccactaaaaaacacttggtgttcaacagaattgtaaaattagtaggtcaaaaggaatgactccaaaacccttcatcatttaacattcaaagctgtaacttttaaatcagtttcttctagcatcattgtatagaaaaaaatcattttttcttcagaaaaaaaattaaaaataaataaattttaaaaatagccttcagattagtcaaaaaattttgatgcattcatatgagaaaatcgaaggcattaatatggcggtatgatgtatgtctactgaactcaaaagtttagtaacatgttgagtgaaataaaaactatagaagaacatttaaaatttgatgtctttatatatcttacaagtgtgtttatttatatttgtgtgtatatacaaagaatatatctggaaggacatccataaagtattgacaattgtatccccaagtagtggaattatataaggatttagtttctataattttttgttgttttgttctctttatcttctatttttttttctggaatgaacatggattacttgcataattaaaatattaaaaatagactttgttttgaatattgtgtttgcaagactggttcattatcagtttctacaacaaatatcattttagaatcgataacaaaaataaaagcaagttgtccttatcatctccacaaactcagaaaatagttctacatcaaatataaaccagtacaaagaggcacttgtgaaaggaaacaaatgtttggggacttgacctactccccttccctcctcccttgcgtctcaaagaggtacagctcattctcactccttttgatttattaaatcaccatcttctccctaggctagacaaaaaattcatggttaggatttaccctcaagcttcaggctgactacattgtatttgaaacaagcaagtcatctctgtcttgttgcaaagtttacaggaacatcacctcaataagcacacttgctgagcttattgttatccacctttacctcataggaaagccctactagtaatggactttgaatcaccttctttgtttattcatgaagttgaaagctacaatagatcatgattattttccaataaaacaaactaccagggtcatcgtgatgcgcaactgtgaggggtactattttcatcataggttatattaatggtgccactttgctcatcacacatctgctaacagtggtccaggaaacttcatcctgtaacattttaatcaaattctgcttttctattcagtatttgactctgaagggcattttctccacaaattataaaagtataaagggttttagataagtacaagtataaatataaataaaatatacaggtataaatatgtatatggaagcaaatttttctatatatcctgtatatttcataagtttctataaggatggacttctgattctaaaccaatgggtcacatacattggaaaatacaagataagattgcataccaagttaatcacataaatagaagcagaagttcctacttttagatttggaaccatggtgtgccagatataatgccaaactttatcaactgtagaaaactatagattagttttaaattgtatattcttttcacagttactcccatgttctagagatcgattgttccagttttttaacagctttatttgatgtatcactgacatataataaactgaacataaagtgttcaatgcgataaatctaatgggttttgaaatacatacacacatatgtatatgtgtgtataaaatatatgtatacatatgctgcatatactacgtatatacacacacacacatatatatgtacctttgccataatcaaggtaataaacgtatccattaccccccaaagttctcttctctagctattccctctccaagtaatcaataattttattgtcactgtggattagtatgaatctccaataattttacacaaatagaataatccattatgtactttggggaggggaaggaggagagtcaggctttcactcagcctaattattttaagagtcatccatgttgtgtgatatataaatagttcattcctttttattgctgagtagtattgctgtgtatggaaatggtataatttgattacttattcacttgctaatagatatctaggttgttttgagttgtacaagtctttgtatagctatatgctttcttttctgttgggtagataccaaggtgtagaatggctggattatatgataagtgtatgtttaacttttaaaaaaacggtctcctaaggtagtcgtaccattttacattccaaccagcagtgtagttgagtttgggttcctccatgtatttataaatatttggtgtggtcaatttttttttaatgagacaggttcttcctatattgcccagactggtcttgaactgctgggttcaagcgaacctcccacctcggcctcccaaaatgttgggattacaggcgtgagtcacagtacctggatatggtcaatttttaattgtagctactctattcagtgtgcattactatttcattggggttaatttacatttccctagtgagtaaatgatgttgagcatatttccatgtgcttatttgttaacatatattttctttagtgaaatatctgctcaaatatttgaccaattttttgctgtgttttcttaattgttaaattttgagcattaattaaatattctgatataaatattttgttagatatactatttgccagtattttctttcagtctagcctgtcttttccttcactgaacaacatatttcagagtaaaaggtttaaatgttatcaatttttaaaaatagataatgttttggataaagaatctaggaaatctttgcctaacctaagttctcaaagactttcttcaccgttttttgaaaaaaatataattgaggttttttattaggtttcagatacatttggaatttgtgcatatagtgtgaagtaatagatcaaaattcattttttatttgctgcatatacaatatttcgggaagcatttgttctgcacagaattgccttgtatttttgttagaataacaacaacaacaaaatccaaaaccagtttattcatatatgtgtggatctatttccatagtttattccattctaatcacttatttctatttttatgccactaccacactagcttggtacctgaaacaataaaataaatcttgaaatcaagtagtgttatccttttgttctttttttccagtggtattttagctattttaggtcctctgtatttatacatgaactttagaaaaagcttgaaaaatttacaccaaaaaaaaaatgcttattgggattttcactggaattacattgaatctctagatcaatttgggaagaacgattatcttaaaaatatgatgttttctgacctgtgaaaggcatatctgtctatttatttaggttttctttaattactctcaggaatgtttttaattttcagtgtacaagtcttgcccatcttttggtcagatttatccccaagtattttatatttttgatgacattgtaaatggtactgtttttctaatatcagtttgcatttgtttctcgtatttagaaatacaattaatttctgcatattaatcttgtaccctgcaaacttgttaaactcccttactagttttagtggttttacagatttttatcagatttttatataaataatcatgttgtctacgaatacagaggttcatttctgtctttccaatctggatgtaattttttttcttgctttattgcactggctagcacctccagtacaacgttgaataaaagtggtgagagccaagacatccttgctttattcccaatattaggagagaagcattcagtctttcattgttaagtatgatgttaattttagttttttcatgtatgtcctttattaggttgaagaagttcccactattcctaatatttctgagggttcttaacatcagggacagatgttgggtttagttgattgccttttcaatatctattgagatgatcatatgttttcccttttctagttcgtcagtatggtggttatcaatacagtaatatggttaacattttattattattaatgctgaattgcaaaacgtaatttctagaaaaatggaaggttagtcacagttgtgcctcaatgatactagattagagtgagtaaggtaaataaccattttctttcctaagaatttttttttttttttttggaatttcagttggctatccctgttacaactgcttttgtatctatatttgctacatccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctgaagtcttttcatgtagctaaagtgcaatcatcttggagacttattttccagtaacatgtcccagagatagaaatttatctaaatgttatctaagttctttatagcctttggcacatggtgataatgtattaagaaacaaaagggggaaaatactcaaaagcttcttgcaatgagaacatttgtcactggtatgtgtcatgaaacggacctgggcatgcaaccaagttaagtaattacactggtctcaggccaatttaaattgtgtgctatagaccttctatgtagaaaatagtccataggttctgcatacaagcatcacatgcaaaaaaacgtgatatgaaagtcttttgttccccaagaaggacctgaatgtctgtctgtcgacaagacaacctctgtgggtacctcactgacatagtatacatggtgaaaaagaaagtgtcaattggttgtgatcatgatcagtaaaaacctatttggtttataagcctggatccaatcacactgatatcattctggactcaactgtcctttgtggttcaaggacataagaaaactgaagagaaggcttgcaacttggatgttgaaaagaaatttattgaaaggaacaccacttgaataacttttactacctccaaaaagcagtatgttctctctactggaaaagacctaaatacactcaaaaagcttactggaggattttttcctattaatttgaacgtcgtataggaacacaaaatttggttaaatatttgatagataagtttggtattaaaaagtccacttggttcattataaatattaaaattaggaacatgtgttctttgtttaagcctgataaagctttagctgagatcatgagttttcataaaacaacttttcacaacacaataatgtattaggtcagggtctactgccctcctgcagattttgcctgatagtattttcatacaaacctcatcactcctgctttttctcagatcttctctgagcttatttcctaatgcaaatcttgatttatatcagggccctaacgtggctgtccaaaatacctccctcccccaatttgtgttttatctcaatacattacccagtggtggcccagcatctcagagtgcccaacatgtaatcttagtctcatagggataaaggaaagcaaccatacctcagggcattcatcatccctgaaagtccctctccctgtcttaccatgctttatgtcatcatctggctcatttatttatttataaatagccctccactcaaataacactcctgaagggtggggaatttttctactttgttcactcatacggagtaagtgctcaaaaattgtgttaaactaatagcattcagttttagtaggattagttgcattaaaaatacatctcctagaattaagattgcataatatgttactgaatagttcggcttctttgaaggtatccttggcagagacaaggttagttctccctgactcaagcagagatactgttttctcaattctcttgttcgactaactcctctctgttatttattactggagacagacagtatccatcacttctcagattgatgcaaggcagtggtaataaaataagctacatacatcatgtaatcatattggttttatgaatcatatttttctgaattagggaaaatagttgttttggtttaagctggagaaaaattctgactcatgtcaacaaatcactgacaaggcaagcactgataaaaataaaaagcttaaagcaagttttattagagaaaacttgcaacaactctacacaaacattgattaattataggctcacttggtcttctttaaaatgaaaatacttttaaagacatgactgtatgtcaacaactaaagaacaggatatataactagaaaaataggaatatttatttaaaatgttatactgcattgtgcttttttttaaagataaaagctatttaaaaatgaagcaagctcaatttgtaattaggacacacaattcctcaaactctgtaagtctattaccttaagttgcccttacttaaaaaatttattcttatctgaaaattatggcaatgtttaaaatgtttaaagaaaacagtaaatttgtgttatgtccccaatttttgaaatttacattttattttcatcatactgaaaacctgatgctgaccttggcttcactcctcgaggtggtatgtagagttctgtgaggtcattgctgtggatattcagcatgcactaacagtgcagatttcctggtgggtcagggctgagaggattggagagcaacactgaagtgtataacaagagaccagtgcaagctttgatttgaaagaaggcactaaatatggattcacggcaacaagtactatcacatggaacacttaattatttttctttctctctttacatcttaagcaggcaaagtcaacttgctggaactgggctaagtttgggagtggtaaaaacaaaaagtcataatcatccagtgatttttaaaattctggtgtgcgtcagaatttcctagaggaatggttcaaaatatgattatctgagcctcatctcaaaactacctaattagagcctctcctgaaagaggctgggcatctgtcttttaaaaacctcattccaggatattgttctacttaacactattcaagagctgttagttttgactcacacttactatgtaccaaggatcatactaaatcacttcaatgtactacattaactaatgatcctacaattctaggattttggtattatttttatatctattttacagaaaagaaaaaaaaactttataacatttccaaagccatgtgaccagtaagtgatgaaaccagaatcacctgacttcaaatcacacacttaactcttatacaaactgcctccaaccatatggagtatagtgccccctataaatgtagaccgttgctgtctaagtagaacctagagatattttacaaaattcagtcccaaaatagtgctactatttttatttactaactgcaattgatgaggaaagtatatgcattgaaattcagtctttaggactccggaagttacacaaggctctatcagacgaaagcctaccagctatatcaagtgcctactgtgtgcaacgcttaggaaagttattctctggaagttgttcttttttttccctcaacttttcaatacaatgtttgagggtaaaattgctatctggggcaaagaatttctgcagatgttactgttactagaatgtgaacaatgattctatggatttgccactgctataaatacaccaactggaaagctttcaactcccaggaaacaggatttggaaagtgagacaggaatacccagctgagaaggtaatttaggtagacacaatgagaaagccttaattcctggcatatttctgttaacaggcagtgtgggaatggctttatttcacctctgagagaaatccaagcgatggattgttttatgagatgcgtgtgatcacaatgagaatttccagtttcctaaatagaacacttaacaagtgttcgtgaagcttccagcaggtcacaccattttaaatgcagcacacatagctcaacactgactctctttaattttgctttctttcactattcttggaggtacaggactaaggaacccactatgcctcacttaatatcatcagggtttttagtcttctcactggttttctgaagcatggatttttgcagttcctagtcaattaattcttggagcttcctttgtcacctggttgatccagctttggtagcactgaatttctctctagaccatgtgttctttatcagagacgttcaaaacacgttttctgaacaaatgattaagtgaatgaaagagtagatgcctcactaagcagcacatctcatactcccatatattatatatgagcagttccgcctgtcacaaagctcctccttatgttaggcatgacagtaacacgaagtcttcatttgactttcctccattagccatcattctgcctttggagagctctgcaaacaattcttccccaggacaaccattttagtagctgaaagaagttattatgaactcccaagtcctaattattcttccactttcttatcaatttcttaaataatatgacctctagatatatcacaattttgctcctccttctgtggagagagcttaccaatgtcgttattaaaaagtggcactaaaaactgaacacaatattgctgatgtgaacaagtggatggttctgcatcttaaatggggattatggcacctcccttttaaagctgttacatggaaatagaatgatggtcaaatgccaagggcacaacaatttaagagatgggactcaataaatattggtatttgtctcatgtcatcattatcatcattaccatcaccatcatcttcatattacctaagtctctcacagcctgtatagttgcaggtgttttttatttaatgtaagtgccacatactacatttgtaaatacacatacattgtttttccctttcagaaaaatttcaatacttattcttttttttcaatgcaaaaataaacatccgatgttttcattaaaatatagattaaatattagccagggaacaggggtcaaccttgtcctccaacatgacattattctccaaaccattatgtccactgcccttagttgctggtacagtttacctggcattagctgatggacttctgaaaatataatttacttttaatgagttgtgtgtgtttcatgttgtggataaccctaaacaaataaatgtaaaactacaatttgatgtccaaaaataaggaagaatgggatttgcctaaaatcagacgtttattaaataacaaggaaatagctttcagctatattaggtatcttaaaactcttaacattgttttgaattcactttgatgcgtgtctcactgttaagaaaagtgttaagacaagtgaagaatggtttgatgttaaatggatcatggaacacaggagatcatatttaaaagggaggttttcctccattttcaatatttcctaaacttaatctcttaagagtcttctcaaaagaacaatttatgaactctttaatggaaatgcattaaaataaaatgtggccgacctcttctttccttgtagcctcagaacactctatcagtcactactcagaacaaattagccaatttggctgtgagttacccacagtttttatcccttcactccaatagcctggatccctggactgcccactctaaccatgcaggcgggggattgtgtgtgagaaggagccatgcaagccacagggaagaggctgtaaactccctgaattgggagctaaaaaccctttgttcgatttggctctgtatatttttcaagatcatacatctacttatgatgccaatgaatcaatttcctcatctacaaattaaaggggatatgagacatctttatttgcaaagtctttctgtcgtacaaatccaacagctgtatattttccttttcacataatgactttagcatctcatggacaaacatctgttaaggaatgtaattgttttttctgaaatctcggtgtatggtttgcacaagtaaattaagacatttataaccagtataaccatgtatatcatttctaactgggattatatttttcagaaaagaaactaaacctcaagatttgcatgctaaggcagacagtgatctataaacagacccgaaggctctcagtaacgcatggggtctgtgggtccttactatctgtattagtctgttctcatgctactaataaagacatacccgagactgggtaatttacaaagaaaagaggtttaattgactcacagttctgcagggctgtggaggccttaggaaacttataatcatggcagaaagggacgcaaatacatccttcttcacatggtggcataaaggagaagtgccgagtaaaagcgggaaaagccccttataaaaccatcagatcttgtgagaactcactatcacaagaacagcatggaggtagccacccccatgattcaattacctcccactgagtccctcccatgacacgtggggactatgggaactacaattcaagataagatttgggtgggaacacaaccaagccgtatcaccatccatgtaacaaatcacctgagatactagtatgtaaagtattttccactcatttaatcaattcacaagcatttattaaacctctactgtctgattcaactaagaaattctgctgtcactcattagtcaacttagggtatgctggtgaatctctaagcaaatggaaaggcctatgatgactctcactagaattgacatagcaattattcacaaagttcacatatttttagcagtaagtcagtttctttgaccttttttacccatattatactgcactggatgagcttaagaaaagattatatcagtaataattttaggaaggctgctgtgtggttttgcatagtaagaaacgagttttccaggtatccctgggttcatcagctaaacttcttgaatcagaaaactaatttattaacctttctttttttcattccatggaaccaccccaatatcttcaactcagtaggtaatccatatataatttttgaaggaaaaggacaccataattttctcacatttaatgccttcacaagctgggcagtgtggttcacacctgtaatcccagtgctttgggaggccatggtaggaggattgcttgaggccaggagttcaaggccagctgggctacatagagagacctcatctctacaaaaggttaaaaaaaaaaaaaaaaaaaaaaaaattagatgggcatggtggtgcacacctttagtaccagcaagtcaggagtccgaggcaggagggtcacttgagctcaggagtctgatgctgcagggagctgtgatgacatcactgcatttcagcctgggtgacagaccaagaccctatctctaaaaataatgataatgataataacaaaaataataatgccttcacaagtatctataaaaccaagtttgaacactaccaatttaataagaaataagatgattataataaatgccacttatatagtgcctaccaccatttattgggtaacacacacacacacacacacacacacacaccacacacaccccacacacagaatctcatttaatccttagagcaactctctctggtaggttttataattcatatttaaagataaatagagacatatttagcgttgttcagaaaagaagaggcatattccatttcatttttgctaaaattttagttcaataatttttataatttaaaattgaaggattatataacacttaaactaatgatggacagagattactgacagaaggtaggagcatttacagaaatattcttatttgtaaagcaacatcacataggcaactataatgcttttgttctcgagcttccagtgtctttatcatagaaaaattacaagattgataataatttttcttaaatggctgtgaagactgacatccattgcagtgtttccttgataaataatcatcctggattctgtcaatatttccctttcataatttgatatacaaatggatgtaacttaagactttaagacactattactgtccataaaaagctcacaggtcttgcaaatagaattgtcatgtctgaatctcaaattatttcttcacctggtttttaaaaaaggtcaatttccttagctaaaaataactgagtgattaatctattcaacataaaacaaatctggattctgacttacttgcccatcctaacttcttttttcaatccccaatttaaatttctattaacactcattccgtaaatatttgtctggcaaaattcaagtaccaggaaacagcataatgcaaaattaacagagtagcactataaagaagcatatgacccaaacagctgcaactcaatgattatctgtcccaatgcccagttcctaaggggggaaatacaacaaaaacaaaccctcctacccaaacggcttccgagagtgtttaactagatcctaaatccattgctgagatttagaaatatttttaaatgtttaagggatatgaagtgatgccagaaaactcagtctcttatcaaggtatctatttcacttatgaatagataggaaactagtatgagaaaggtgtttcaggagtttaattgtaaaaaaattataagaattttttaaagtctgtacaaaattttgcttatttccgtgcatacttaacttataaatagagttactatgccatttatattccaaattgcaatgcttagcaagttaaaggtggggggggggctgttaacaattacagtatgtgtaaaccaagattgtctcatgaaaaatgcggcatatagtcaccctacttataaataaatttatgtaaaaaggtgatggagatattctaaacagaaatccacgagattgaaatatgatgaggtaaaaggaattagtgaagagcttttaacttttagatcgatactgggttaaaagtagaggtagcatgaattgatactctaagtgagaaggtaagaagggcttacatttttaaagaggggaaacgctcacaaaagtcaaggagtgggaattatacctggttttgaacagacaactataaaatggggttcaaataaagatggggctatttcagaggcacttcctaaaccaacatggcaagattatttaaatttcctgttgtacacttaaacaggatcaaacattccatttctttcctaactcagaagtattcttccccttgttatcactacgaagggaaatgtcatagattcctgctctaaatatgattcaaagtgaagtagctcatttgtttattaaaaatgtagggttttagtctccacaaagtggcaattttgttcatccactggggagaattaagttattagtttctctccctctctcccttcctttcccttcccttccttcttccctccctgtctttctctctctcttttattcagaggcatcaatgtctcaaatcttaagtttatcaggaacatactacttttgattccccacaaaggttgcatcttgacaagttcttggttgaactagaaatgtcgcagtagcatgttttgctattaaagcacacctggaggaaaagaacatcctctgatggtgcagctgtttccagatgacctccttgcagtgcaacaaccaaatgactgcaaagatgatgtggctgagatatggccctggatctctcctctccatgtgcccttctgtatcctaacagcacttccacactctcttctccaaggaatccccaccacatcccttctcactctttccttaataatgatccaatttatttatgtgaaggcccacttcctccccacagacagagtctgtagagaaaaaaaaaaactacaattaattccttatagggaaaacaacttgtattttctcttttatgaccagaaaaatagcagacagttttccttgtgaggcttcagattgatgctcaatgatgtagaaagagcataactctgccagccctagtaagtgccatgaaaatacttgaccttttgaggtagggcaggaagagaatgtttcttgagagggctgccaggcccctgaaaccaggaaaaagtcccagcctggcccagggagctgcttttcccttgcaaaccagtggagcagataaataactgggctaatgatatccctgagaaaggctaggcataatgactacattttctagaaactcattattcaatttatgagcaacctaagcatataagaaggctgcaccttttcatattttgtatctcattgttatattacatgttatattataataccattaaaaaattgggtcagtttctttcagatccagtcttaaaacctgaatcaatataataggtgtttgatttcagtcataaaaaataagcatctcttgggccgggcgcacgcctgtaatctcagcactttgggaggccaagacgggtggatcacaaggtcaggagatggagaccatgccggctaacatggtgaaaccctgtctctactaaaaatacaaaaaaaaaaaaaaaaaaaaaaaaaaagtagctgagcgtggtggcaggtgcctgtagtcccagctacttgggactgatattcgatatttctttaagtttcactatcctttataggttacctagaatgggtaaaaaggtaaaatgcacattaatgtacacatgagagttcactgctgggcctccataatgtcaagaagcatgagctgccttcttcacacgcccacagggaaagtcagcaactcacctgtcctgagctgactgacaagcagatctactgcaccttctatcagcagctgtgcaatctgtacagtggtgaaactgaggatatcttgtctggatttttcagacaggcctaggtagcaaaactataggactcactcatttgcaccagcctcttcgaactcagagctagggaccgcagcgtggaaaaggctactggggtgcctgcccatactctctgttttctgtttaccccttattttgtacttgtctttgcctgtgctgctaaacctcctacttttggtacagtgcactatgtaaatcaagagaacagatctcctggccaagaccacctcataatatagattagaggaaagatcaaaaatagtcatagcttttgaaaccacagtgcttctatttgaaaggctccaataagcagcagggaagagataaaaaaaaaaatggtgaagaaagggaacatcagagagttatcttactgttaaaaacctttcttctctgccttggtcttttcttgtcacagcccactcattttgcttccccaccttccttcttaactatcctcttcctctctttctctttctaactttcgaactgccaagagttaaaggaaaaggtggtccccttgtccaaaatgaagagatgaaacaaatttctggtactgatcaatggttatggtcatcactactatgggctactaatggttcttgacagcctagtaatgacttgcatatttaaagaggactcctttcagtcacttccaggagggcctgtgttttaagtattctcttaatctaatctgtttgatccatttaaattgacgatgtaaatttaaagatgattgtgtggaaacaagagaaggatcctaaccagactgcagaggtattgatcccaaggtcagggctcattagtagaaattgctaatggtccaagtaatcttccaagctcactgtacaatattaggtcctccataggaaacaaaacattacttttgtgtaaaacaacttgtaacaacaatagtaatacaatatacctattttaaaaagaaaagaaactacttacaattctactactgtcttaaattatataattttaatttattccctttcaatctttctcatatgcatgttatacatttgaaacctataatgcacaaataattgtatgccctgctccttcttaaatgataattacatttctaatttgatagtcttcatagtttttaaaagttgcatgattccattgaatgacatacaattcacatgaacattccactgttacaatactggacctttgaattgttttgaaagaactctgtgaagtatgtttgtgcatatgacattttaacatttcacattattcccctagaataaagtcccaaaagaggcattatgtgtcaaaggaaataactgtttcatgacacttaatacatgttgccaaatttcgcagcatagctttttaaaaaacgttgtgagcatgttctttctgcaaatcactttgctagactgtgaggcacaaatgaatgagtttaaaatacagtgcttcaccgtggaatactatgcaaccataaaaaaaaacatgttctttgcagcaacatggatgcagctggaggtcattatcttcagtgaattaatgcaggaacagaaaatcaaatactgcatgttatcacatataactaggagctaaacattgggtacacatggacataaagatgagaataatacgacactggggactccaaaaggagggagggagaaaagggctgaacaactacctattggatactatggtccctacctgggtgatgggatcagtcataccccaaaccttagcatcatgcaatatacccatgtaacaaacctgcacatgtaccccatgaatctaaaataaaagctgaaattatttaataaataagtaaataaatacatgcagaaataaaactgaaaaaaaaatacagtatttgccctgaaaatcatataatacagttggggaaataagacatacacatgtgaaaagagaactaacaataccaaccacaggaattcagagaagaaagaaaaagagcatatttagcagaagagggtaaagagttagacttttgggatattctgaggtttggatgagttgaggtagaaactattcaggtcgataaatagagtaaaaagaaaagaaattaaccattccaaggaattttctgtgacttaaaagcactatgtgattaaatttaatgtattatcctggtccacatagactccccaaggatctttccattattagtaatagttattctttcacctttgtccttgaaacatcgacttcccccgttccatttgatgtgatactgtggaggtttatctcctctgcctctaatcagtccttaacttctttcttttaaattcatcttcctccaaccaccaccatgagaacatttctcaaagttctcctgcagttttctccttctttatatatttctgtaggtaatgtcacctgatgacttagctcttgtcattacttcttgctgcgaatcccccaatctctattttcagctctcaattctcatttttgttcgcatacatacattttccactgcctcttacagcagtttaaactagatatcccaaactgaactctttctgtggtctctagataatctgaaagcaccacagttcgcaagcgtgtcatctttcaggtctctttcatcttcatagctcacactgaatcagtttccaaatttggtcccagcttcccagtgacttccaatttcctcctattgtaggtgatcaaaatctcccacctggactattgcaagggctcccccatctgatctgcttgcctccagcttcagccccttcaatctgtggtctacaccattaccagttgccttttaagagcacagagtagattatgtcacttgtctgcccaaggacttccagcaactctagaaaaccagcaaagcccaatccagacacattaatgtatccctcctggtcccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatccttcccagacctctgtctccacaatctgaagtactattaacttcctgtattttacagcactgaatggttaattttcttgctgcctgtgcaactacaatgttccctttctggaggccaagttaataaattcaatacatccaagtgtgtttaaattttttaatctctttggccaagggctgaacttcctcttgctgtttgttaaatggctattggaagatctcttgctaaacctgaaagtatttaagatgttcaacagaatcctcattcacagatgtgaggaagaataagagatggaaagagaaaaggatttaagttactaatgatttttctttccaatcagccctatgacgtatcttcaaaaccaggccaagaattctcatcacttgtcatgacgagtcccttagcaaggatagggtgctgcacattcaagttcttgttttaggctcttgctcccatcccaggcccttgcttaggtttaaagtgagagctttaagcagggaagactcccaggttgcaagtattcctcaatcccatcccactgcatgtgatgctgactggagtcctggcacgctgtcacagatcctagcataaaaataacctgaggtaggatagaggggaaagagaggaagggaatttatgaccaaccctccagctttatttatcacttaccctgggaaagtactatgtaataaaaagggggggaaaaacaagacagccaagctatttaaagagcaggagctgaaacttcagaagcataaactaatgtttctaactaaaaacgggtgtggagcttaaaacttttcaaaaagtagatgctagatgcatatcttaataaaaatgaattttaaataatatttttgaatggactatcctacgctatttattaggactaatggttattcccaagacccgttctaacttctgatcattagaaggtaccatatttttccatttgcatagtagaggcaggatgatagtatatgtttttgtctgaagtgagactattaaaggaaacacattaaaatgatgaggataaatggtcatgtgtcatcaaggccagtccttcctgccattctttaagctgaattcccataaaatttagttttacctctttgaaaactatgtgtgttgttggactaaacgtaagaaaagaacaaaaccaaccagtgaataataaaggcaatgtctaaggctgactacatttggtatattaaaataaagtagaaaactggaaatacaagagtagtattcctttatgttttctaattagtcatttctgatgttttccctgaatttacacatcagtccattattccaagcagggacacacacacacccatcaataaattactattataaagagaggtaattgtctatatacaaaataaatatactactagttgcttatagttgcaaaggtaaatgtggaaattctcttcattttaccaattaccagctcataaaggaaaaataaagttaaaatatattctctttttgcacagactgctaaataattgactgatcatgattaatcaagtaaattgaggcattctggaaaaatgacaaatggcaagatttactgcctctggaatctacggcatttgctaaatataacttgcttgtaactacagataaatatctaatctaatacaatcgagttacctgcaaaccagagccacatacaaaattgaatgaataaaaacgtctcaaaagacaataaatactttctttcttccaaatgaaataaaatcttatgataggttttgaggagtacacgtagatgctaggagcatcagctttgcaggcctgcagacaagggttcaaatcttggctctaagcctctgattcctacctaggaaaatgagggtgatattatctatggtatgagattgttataagaatttattgagataattcagtaattgccatatagtgtgctaagcttagtgtctggcacataatacattatcaataaatgtgtcttatcattactattgtcattatttattaccactagtgagaggctagaaagtgaaaagtctaaccaatgcttttaacttcattttctacagaatattcatagaatattcatagaatcataaaacacacacacataatgcctactatatttggtacttgtctgtattcacttctatgacccactttaatgtatatgcaaccctacagtaaagaacactcccgggagaataaaaaagtgccctttatattagcaaaattttatgtgagttaactgcataaaataggatgagttttgtactaaaactcatcaattatttttcattagggtggctttttatttatttattttattttatgtttattttttttttgagacggagtctcgctctgtcgcccaggctagggtgcaatggtgcgatctcggctcactgcaacctctgcctcccgggttcaagcgattctcctgccttagcctaccgagtagctgggattacaggcggccaccactgtgcccatctaatttttgtatttttagtagagacagggttttgccagttggccaggctggttttgaactcctgacctcaggtgatccatcagccttggcctcccaaagtgctgggattacaggcgtgagccaccgtgaccggcctaggatggcttttctaaatattttcgtctatgataatttttctctccatgtatttatttattttcagacagtttgaggttacagtgagctatgatcgcactgtctggagtgcagtggtgtgatcacagttcactgtaacctcaaactccttggctcaagtgatcctcccacctcagcctccctaagtgttgggactataggcatcagccatagtgcctggcagtgagttttctaaacagagatttactaaaaggcttgtgtagtgacttggcaacaccgtaagtattttatttctaaactttgaatgcctttctaaatgtcacaggctaggtctacgtaattccctttacagcaccacatgcaattggctgtttagaaaatgctttttgaggatggtgaagagctctgtttttcattaagtggctttgaactttgagactgcaagtcctgactctggatttaccctttacttcactacataattcaattcaaacagtcaaatgatatcctctttctgcaacatgtgtgtggggggaggacgggggcggggggcggtgtttccccttacttatgtatctttatcccgtgagttcattttaatgaaagaactccagtcttccctcaacttccttattctgaccttgtgctctagtactaagtagtgacgccagggagaaaaaaggctggtgagccaaaaatggcttaggaacataattctctaccaagctgcagaaaataaatgacagggttggctgaaatccaaaggtcaaatatatacaggctttcttatgggaaaggaatgtcaaacctgtttaaaaatcctgtgaagtgagtttataatccctgactaccaaaattaaccatccagctgaatcattttaatatttccgtgaataaagtagattgattagcttttccagagttatgtgttatcagataaacaaaccaatatattttaaataaatccttttgacccaaatggcatggtggagcacaaaatgcttaaaagatgccctctggacctcctaaggtttttcataggaaaagtaaattagctagactattttcctttctgcacaatgcaatacaagctgaaataaaaatgtagctttctcttccttagtcttcttttttaatgcttctgaattatgttagaattttagagcttccaactggattaaaaattgattcagcagaatggtaaattacgaaaaaaaatctcttaacgaaaatacttgttgcactcagttaaaactgtcttttaggccgggtgcggtggctcacgcctataatcccagcactttgggaggccaaggcgggcggatcacgacgtcaggagatcgagaccatcctggctaacacggtgaaacttcgtctctactaaaaatacgaaaaatttgccaggtgtggtggcatgtgcctgtagtcccagttactcgggaggttgaggcaggagaatcccttgaacccgggaggtggaggttgcagtgggccgagatcgcaccactgcactccagcctgggcaagagagcgagactccgtctcaaaaaaaaaaaaaaaagaaaagaaaaaaaaaaagaaaaaagtgtcttttattcccaagctagcataagaatgttgaggtaaccaatgttattggggaaaaatctgaattctattcattttattcaagacctaggtatcccattgagcttattctactttgtggtagaaaatatatatatttttctaactctcatatcttcttaatagtataaacaagaataaataaaacaatttcaattttaagagtctccttatcattattgtagcataccatcacttgtcccctattagtttggagtcagtaatcatcacacaaaaaatatcaatatgggctgggcgcagtagctcacgccagtaatcccagcactttgggagctaaggcgggtggatctcttgaggtcaggggtttgagaccagccggaccaacatggtgaaaccctgtttgtactaaaaatacaaaattagccggacatggtggtgcacacctgtaatctcagctacttgggaggctgaggcaggcgaatcacttgaacctgggtgacagaggttgcagtgagccgagatggcaccattgcattcagcctgggcaacaagagagaaactccatctcaaaaacaacaacaacaaaaaaacaatcaatatgcattatcatgtatatccattttgttgcaacatcatcaacatatctatagaaacataagtgttagaattagctaaaaggagccttagagactatccacctgccttgtttctgaagtaaataaaatgaggtttagagaagttagtgattttctctgcattccagtccaatgtgatgttatcaatggaggaaagaaaaagtaccatgtactgaatattgtattaggcttttgatgacttttagcccagtcaaatactcaacgatttaataccaaaggcataaccatttcagttttatatagacatgacttaagtgtagtttaaggccatatatctggacaatgacaatattttttacagccaatgcatatttttgaaatcacactagaaaatgaaatgtattaatacaatttggataatatatatgtgcattaaaattcttaaaagcttattttattggtaccagtaataaaatcattatctgtgattctaccctggagaaggaagaagggtatgtcctgcaatgcactaaaagggcaggaatcatgcccttaaaatgtcctgaaaacatttttttcagccataaatatgaataaccaaagttgagggttacgcactaatggcaaaattatcagatcattgatcaaatgacgtgctattttcaggcaggcaataccataatagcaaagcaaagagaaatctaatttgcatctgggacatttaaaataaatatattaaagaagaactgttgagccagtccctcggccatactgctctcattctcagcctaaaactagtccctcagcctttagggggtgagggggcagcagtaggcttcatgtcacctaccactgtccttgtcttccccctaacctgtaccaaggccttcagtaaattcggtcatccctgctttagccaaaaagccaaaaactctactgatatcaactcatggatctcattctccaaagaggtcattagtgctcccattttgtaaacagtcatattgtgaatcccaaatgaatttcctgctaagataaatagatatagggaaatagttttggatatggatatgatatagatatacaatatccgtatattattttcctacaattatcatactacaactggctttcttttctatcattttagaaatttaaataatgtaaagacaaagcaaatagatgtatgcccataaagtttagcaatgtgctcatatatttttctaatttcctagaatatcaaaatatgaagaagcactgaaagaagaaacatctaccatatattgatgtatttcaaattcagatatggcttcatctggaaagcacactccctgtaattaagcaaaagtggttagtctataaccataattaaatttatattgtgttgtcaagttaaaactgtgaatactgtgtacaaccaggaaaactggatgggaatgactgacttaataaactaacttcttttaagaaatacaatgaacatagcttcctttcccttaattgtatttttaaaaatcatgtgaataatacaaaaatatctatgctacaatatgacagccctaaaagaacagaaatgggtgttttccatggcccacagggccagtctaggaacagccctttgctacaaactacatagatcatgaaactgacaagtgattgaaataaggtaatccttttattaacaggaaatgaatgtgttttgaggctctgcctttgtcatgattatctggctctatgtgaatacaggctctttgggaacctgatccaatttatatcagtggaatgagcctatcagagaaattcaagaaagagataagtgaattaagtttagaaagcactacactgctagttggtatatgaaccaagtactagaaagtcagtggggagaaaggaaaagtccatgaagtgggtaatgctagagctacacctcaaacaagttggtatttacaaggcagacaagatagggtggcatagttccttatgatgtcatgccatgacttaaaaacgaaatccctgccagtggtgaagagcaaatggctgttctctacaatgctccattcccctctaatctcaaggatgaatttggccatcctaattccactttatgtggtaccttaaagacatctgagcatcactggtacagcaactatcatattgcattgtaattgcctgtccttcacttgaaggtgggaaacatatttatatcacactgtaccaatgtccagtatatcttatacactcaaatgagtaaacaaattaatgaatgaataaggatttaaccaagacaacaaaggccttgcaggggcctctcttgtctgcaattcatcataatgtccactaaaaatctcagaatatccattttatacatggtcaggcctcggtactcctgagaggcctaaactagtacagagggctcctcaagagttccagataaatcttatttaaccataaggctcttttctgaaaaaatagtgtcacatcccttagggaagttatctaaactgaccttttcccctgggaatcctccagtcattggtctaggcttcatttctgaagatgctatgataggctatcatagatatagactgttaagttcactttcgttcacaaaaatacaggcatgaacctctgtgtactgccagcatgttccgctttaggatgccttaatatttttattcatgttttcttttttcatgaaaaaaataataaagtccatggtaatattatagactgtggtgtcagagatgtcacatggaatcttgactctgccactttctgtttaactctgggtgaattaactccctgagccacagtttcctaacctggaaaatggggataataatgcttactttatagaggtggtgaatataaaataagatgcacctggcataatgtaccaaattgatattcagtaactagcatccttaaagatgcctaagaagatatgaacctctttgtaatgcacttctagaagccaaccaatttttctcaacatggttggaaacaaggcaaatgttgcttctttttacatataagcatgataattgtgtaagcgttttaactaatgtgctgaccatagtttacagtgctgtgtaagttcaaaaatgtcaaacacattttttaagaatgggggaagtaaatacattcactgttttgaaatggtattttgatatttatacatcaaatgtagtattttcttaggtataaaattttagtatgtttatgcatcatcataaacagtgatattgttttgtaaatatcatactactactcaagacagctcagtcgtacagagtagttttattttctcacccgaggaccctaaattctataaactttaagaaagtacctgattctacagggaacccatgaaggaagtcaggtaaaaaaaggaaaagcaagaaaaacaacaaaccactcacctccatagcgcactcagcaatgcaatggtagttagcagatccaattaccagctactcagtggcactcaatggtattacttggtatggattcatctccttattttctgttttgcttttctctgtatactttaaccacaatctcctaaacctttccccctaggtttccattccatttattttcttgtgagttacactcctatattcctacttatgtccctaggaaaatgcaaaataattccttctattcatggagaaatatactatcctgatgattctatgaagttttcttatttcagttattgtacatcttccgaagtacaggataaacattacattccttgattcttctttttcactgtcagttctacctactatttaataatactaaatcatgtaagttagatgtcttactagtatttagttcaaaaagtcattttgaggtgtgaatatagaggaaagggtgttgaggcagagagagagacagcaatatggacaacatcacccagctcaggaagcaaaggcagcatctgaacttaggaaataatgagggtctgaaagtgctctgtcttaagtttctctctatctctctctctctccctcccatctccctcttctccctctccctctctctctccctttatccaataaggctacaattcagccagtagataatcgtagtggggtagcatcatgcatctttttcagaagacagagatcttcaaggattcatagcaagagaagcctggacatcctgcctgtaagacaagtcttgacatatatcaaaataaatttggcacctggttttactaatctgtaaacaaaaacaaacaacagtgtgtgtgtgtatatatgtctgcatgtatacatacatgtgtatgactgtgtgtgtatgccttaaagcttcttttctataactgggtaatagggaatgaataccagctattctgagaactctgagcctgctgattgaagattactctgagataaaatgcagcacaagtcaaccctcctggcccacaaaccatggtctttgattttatttctgctctgtaaacatcctcatatggcatctgaccctactgaaatcattcaacaaatacaagtcaatgattactgagactaagcaaaatcaacaagactataggtatgtttttcatccataagtgacaacaaaacaagttgtgtcataaagaagtcactagggatgattcttcctttgaaattagatggcaattatcttccataattggattttcttcttttagaaatttcctaatagatcctgaaaggtatcatatgtattacaggaattcagtaaaatgctacgttaattacacatagctgtgacttgaaatatttgaaaacagcgtgctgtatcttatatgagaacaactaaactaaaaatcagaaattaaaatttaagttacaaattagcatataatctaccagagtctctccaagccacagacagtgaacttccctggaaagcgaagtgttggcctcagatgatgggctgctctgtgctattgtgtcaataaaaataagacaacccacaactcagatcacataaacctaggatctgtctgattttcaagaaccaagatgattgatattactaaacaaatacccactacgcgcctctggcttcttctctcatgtttcttttagttcttagtaagcattgaaatgataggttattcattcctaagatgtcattatctgtagcaaccactgtcttgcagcctgcatatgcttcatgtcagatcagagtattctgtttaaagatgaccagtgattagataaaggtaatgtgcattctctcattacctctcatctagatagcggcaggaggaaaggatatcagaaggcagcagcactgtgagcctctctgatgagcagtggcaatccagttacagagaagttgagggctctctaaagtgaggcagtgccagaattcactttaccatttttatgtacacttggttttagaacttgttctagaaacatatattctaccattttcactgtaccagattgtgaaaagatagtaactgaagtacaaagtaaataagtatatacatgtatgaaaaactgctcagtaaatattaactaatataggttatgaaatagaatgcaatttatgattccattgtcaatatcaccaatgaatgtctcacacatgcataggaaaatttgattaagttcccagctcttactgatgaattgaggtaagggagtatgagttgggcattgtgaaatactttcaatttctaagacgtatctaaatagatggatggatagaaagacagacagaagttactttgtaactataaaaatcatgaacatatatcattatgcagaaaacaaatattcaaaatgcaatgtatcctattgcatacctattgtgtatactttcacaaattcaggtgacaaagctaggtcaatcaaacacaatatatttcatcactgcatgacttttcagagcttttaatgtgtactgtggatgtccactgactataagtagtcatatgaggcagaatacaaatgttcatatgcaaaaaaaccaaaaacttccaacggtcattgtagctcatatcctcattaaaatttgactctttcttttaagtcaagatatattgcatgctctttggagatcaaaaatggtggtttgtgattctgatcaccatggaacctctgaaaactataagaaacatgtctatttcaaacttctggtcctatttctgtgagttgatttggtaagctcgtcaagaagggagtcaaggccaggtgcggtggctcatgcctgtaattccagcactttgggaggccgaggcaggtggatcacttgaggtcaggagtttgagaccagcctggccgacatggtgaactctcatccctactaaaaatacaaaaattagctgggcatggtggcaggcacctgtaatcccagctactcaggaggctgaggcaggagaatcacttgaacctgggaggtggagcttgcagtgagctgagatcgtgcgactgcactccagcctggccaacagagtgagactccttcttaaaaagaagaagaagggagaaagggagttgggggactaggcacatcaaacacagttacccatgcccttcccaggtttagggttaggatttttgatacagaactctcttatcagaaggagagctccacaaggctcaggattttcagagtttaattcttgagactggcctgggcgaatctgtttcttgctaaattgaaagctgggtgtgagagtaaggaaaacggaaattcatcatgcaggtaagccttagaggcctgagggtaagaaaaagtttgaaggagttatttcagagacaatgagatagcacgcacccctctctctacccaaatacactggagacttgtactaaaggctttgattcctacacaaatatacattcccatgagagagttaaactttgagcttttattgatcatttcatatcctactatgaactgctttatgagatccatagtggagaaagcatttgaaggaacggatgcttaagagtagaaaggaatggagtagtagagagaagaggggttttgtttcccaaccagaaagtaactcaccctattgccttgtttggtgtgtactagctttgctttgtgtactccctggctctctttgccttatttttttacatacgggagtgtgagactgaaaattagttggcttcgtgaaacaagtcaattcatcttcagaaaaaaatctcaaagagcactaatgagtattttcaaatatatgtctcaaatttggataagtaagtaaataagtaaataaataaagcaaatggtagtggctaaaaacagctgtcttctaacttggccctgactaacttctagttagaatcataacaccatgactcattgaaactattgtggagtctaaatcaagtaaatgagatagtagttctgggcatctttgcaggttactctataaaatgaaagagttccttctgtggctttgttgattttgcaaggtctttccttggcctatcttctatgcattaaggatctttttgttagcaaaaaagttttattgttttcaaaatatgaaacaaatgatgctttttggaaagtttcttaattaccctaagcctcacttcttccaacgtaaaaattgcagttaatgtacctgcttctcaaggctgttttcaagattatataaatgtgtatgaatgcatgcttttaaactctggggttctacaaaagctattattagttacactggttttttgctggacttctaacattcacaggatgatagtgataatgggtcaaattccattgcatggaccatcaaggaaggacattaattcttgtacttgaagtagatttacctttaagcaaatccttccaaaattatgtattctatctgcctggagtgtggatcctgcttaggatattaagagaaagtatttaaaatcttattaaaaagtaggtagcatgacctttcagcatcatatgggagctatagacctaatcaaaggttatttagttacttagagaaggtgtattttgtttgattcactttattactgatacaggtccaagagttagtaaagtttcttgttaacctagtgaaatttgcctggtagagatacaaataatttttgtctagttgaaaagataaccccaagggttttagtttatggccctatagatattaactactcgtatctaacactgcaatcttattctaagatttattaaatggcctatatatacttagctctgcaaatgctctttaaactggccttaccatcttactggatctctaattaataaatgaataagctatttgacatgtgctcatttgatgtaggcaaatcatatttttaatgttttaaaaactatattaacagtgatacagaaattttgttgttgtagagataattagagtgggatttgttagatggtagaatatattctgatattgaaaagaatagtagtaaaaagtaaatgggaagaaagatggacgagtaagtagttagaaacaaagagtttctggaaattttaaattaacagtgttaaaatttgctttctttctatttcccccagggggccaacatgctgttagatagtttatgatgacaaggaatttagggaacttatttaaaaagtggatccttctaataattggaatatacactattgcaattgtattcaacgatactaaagtctcacacaataaacttcaaggtgcagtgccatttacttacactttatatctcagatgacggagacccagagaatcttggttgttactaaacagatcactcactgcaaatatgaacaaacgtgaactaaaatagagtattcggggttcttgatactgtgttaaacgtactgatcactttaagatttataactgggtaaaatgtgtctgcacagaggtccctcacagtgtacaataagagatggtaaccacgattccagtcataatctgaaattgttgcataagcttaaacttaaactttcagaatctcattttaattatgagtaaaatgaggatattggaataaattatttttttctttctcgggtgatattctattaaaaaaaggaagacaaaagatatatgattcaatgtaaaacttgggcaaaaattacttaaaaagggaagcagagtaacatatagtacagcctctaagagtttttgctgtgaatacctcttttaaactctgtttaattatgcattttctcaatcttatttggccataggataactcacttccacctcgtcttttcttgcccatcacctataaacatgtctatgaacatcaccatgaacttaaaactcaagttgtcagtaactctttgggaacttctggattaatcatctctgaagtcacttggaattctaagaagtcacttggaattctaacatcctattatcacttggctaacatcacaaattaccctaaatttacttagcacttactatttgtaaggcactgttctattcacttaaaagtgccaacctattgagatcaggtgacagtgctggagctcataaatgtcagccttgtatgtattaggatctgtaagattaaatatctgtgccatacaaaattgttcctggtaattatgcaaatgtggctacaatttttttaaagcacagattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatgaaggaacatgctttggagggagagatttagcctaaacttttaaaggacttctatccaacccactcactgtccgtatagacacaaaaagaaagggacaagaaaccagattaccccaggtgtgtactacaaacatacaatagtggctttggttctgggaaagttcatctttgagtaagacacccagactcactgtttattttaatgtaaactattagagagaaaaatgtctgggagaaatgtactcaaaaagcatctgttgagaataaccagtcctatgaagtaatatttaaatgctgtgaaaaaaaattcacagagcttcaggtctcccattgcccttagtcttcatcagtctattcctatgtacacaagtttaaaatgttgaggacagccctcctaggaaagtctcactcagaattgacattaggtcctgtacctagcagcatctgaattcccagactaatcttaagaattcatggacctgatactcaaaactgaacattcagcatggtaatcacatgagatctcagggtacatatacttccccacccaatctctcttcctctcacacccacattaggaacatattgcacaggtcaggatggacaaattctagaggactctgggaatcatcttccgtattttgtttgtctgtttgttttcaaaaagtgacaagaggctataagccatggattttctaattttataactggttaagtccaagcttggaatgccaagagtcttcattctcatttttccagtcctgtttactactccagagtcaagaaactctgcacacggtggttgcttatgataggagtgaagggtagatgttttgacactccgtctcctgtggccacaatcaaagcatagcaagaaatttcactaggggccctgctgctcctctcactacactcctacctcatcaataacaacatctgtatttagtaataaacatgctaggaaaatgttaacgtgcttcataaattatatttccatttatttgcaaagaaaattgaagtgtgatagggtagaaaacatgttttataccacatgtagggaagcagtcagaagattcatgtgagcaacaaagctcaagaagattgtcagaacaaaaaaaatcataccattaagaacatgaaagactctacctttcagctctgagatggacagggccactgatttattcccagagttgttaataaatgaataaaaaaaagaaacagcaaatttgtggtaaagtatccctgactatgagccaatatactttgtaatgaccagaaaatctgcattttgaaaaccctctatgcagccatagaaaagaataagttcatgccatttgcagggacatggatgaagctggaaaccatcattctcagccaactaacacaggaacagaaaaccaaacactgcatgttctcagtcataagtgggagttgaacaatgagaacacatggacacagggaggggaacatcacacactgggccctgtcgggcggtggagggcaaggggagggagagcattaggacaaatacctaatgcacgcggagcttaaaacctaaattacaggttgacaggtgcagcaaaccaccatggcacatgtatacctatgaaacaaacctgcacatactgcacgtgtatccccagaacttaaagtaaaattaaaataaataaacacactcatcaacattaacagtaaaaaaaaaaaaaaaaaaaaaaaaaagaaagaaagaaaaagaaaaccctcaagtttcctgtggtcccctcaccacactgctcagaaccagaaagagtttaagactttgaatggattcatttcttagaaagcctggctgtacatctctatatttagggttgatttcttttattgcacacagtgagaagttgatgggaggagtgacgagatggctgagactcccctttcctaagcttttcttgcctttgtagagttgtaatgggcaatttcttaccacataatgagaaaacggacttgaatccatgctactcaaagcggactggcatccctgggacttgttagaaatatatatgctagggcgtttacctcatacttagtgaaattagcatctctgggcagaggactcaacattcagtgttgtgaccagcactgctttatggctacagcagtattcctcctaggaccatgccgccgtcagagttattttgaccctctctgggaagacagcaagcctaagtcaaggttttactctattccacaagagcttgttctctaatggaatttacaagtctggcctttcaagtacagtcccaaaaatggaatgcaagacacaggaaggcagagaggggaaaaagtctgagtgccaaacagagaagaatgacctctatggctaaattgttttgtctgcatcctgtctaaaggcaccaaaatttacagagaataaactaaaggaaagggaaaaaagtcttgtagctcaatgatctttctagtttggaataattttaaattgagcaataatctgagcatattttcagccagcatctgtctgtgttccacttagtttcagtctgacttttactcccctgggtaatcagcccacacacaagcaggttaggaatgaaaaaaataaaataaaataaaccctgcttatttcattttctgtttcccacatctccttttgtacatacatcaaagcacagcatgtgacagaaatgcttccatagcaccaaggcaatagatagcactttgtatagaaggttggtgtgtcttctgtgcctaggttcaaattttggctttgctacatactggctatttgaaatgtggtaacttactctctgtagcctatcgcccaggctagactgcagtggtgcaatcatagctcactgcagccccaaaccactggcctcaaacgatcgttccaaccttggcctcccaaagtgctaggattacaagggtgaaacaccaacctgggccccttgcttcttctaaactatcaacctaaccatgtaaaaggcagaatccctttgagaacctcatatgccatgcttcttcccatcacagggcctttgaatgtactatcgtagaagtcagcagagaaagaagagaatccaggcttcagagccagacagcttgagctcaatgcctggcttcagccttgctgtgtatatgacatacaagttactgagttatcctctctgactctcagttcccatatatgcaaaataagcataatacccattttacagaggtgttgggaatattccatgagaaaatccatgatttacctttagtggtactaagacttctaattgtctataacatctattggctttaatcgaatgttatactaacaattttaaaataaaactaatgaaatactttcgaaatattgtgtattaatttagtttatgactcttgaaacaaactccaagttttaatgaccaacaaaagagatctttagtgattaatcctgaatttaaagcaagatttctctaatttcaaagtccatacattttcatcttgaaatcaaccatataattaataacaaagataaggagataaaataaaacaatggcttacggtctacacattcttttctgtctaagatggcccacttgaaattataagcaatttaaattagaattttaaaagcatattctcaggttttaaaaaatcagctgtatttgctccagtgcttctttatttactgaaggaaggaggtcagtaatttgggagtcatagagaagctgaagtgtgtttccttcttaatttttacatgggctgaaatgttttcaagggctggaagacggcgtggtgacaggaagacaacgtggtgtgcagagagaagattgaactgtacatgaagaaatctgagttcaaactgcagttcccaccagctggaatccacagggcaagtcatttaattgctctgaagacataaccgcctcctctcaaaatgaggggttggcttagctaactgcataggctccttccagctttatattttgctggtcttgagaattgttagggaagatcacagtgactccaaaaagagaagatcagatctcctatcccatcaaagaacctatctaccgtttcagacattttaaatgccaaacccatacatctaataaaaaagctttttttctgaactctggtttttaaaatgtataacttcaagaaaaagataaatctgcgcaagaaacatatgacacaaatataatgcattttatcagcatatgttccatccctagtggtcacgtttattagagatttaggctgagccagggttggctgtgttctcagaagtacggggatgggtcttgcagaacctctgcactccggggtctcagggcagctagtgctgaaacgtgaccagaaagagtgaggacatgaagagtgccatgtcttgcccttaatgactcttggtggtttcaccagaaagacagagggaagcggtattcagtctggaggaaagaagtgggtcagtctccccacagtcgtaacacatgcatcacagtcctcttatgctttcatctgtcaggaatgggccttcatgttgttgttacactttgacctaatgaagagaaaaatgactcagaataaatgaatcttcccactaataaatgatttcttaatttcgtggtgccatgggcttttttgagaatctgaggaatgtggctcttcttctcccacaaaatacacataagcacaaaattgtgcacacagcttcaagggcttcctagactccttcatgcccattctcattcttcaggggctaacagggaaagaatccttcatctaaatgaaggaaaattaagagtttatgaaaacagacacaatttgagcacatcacaaatgtggtataagcctgtttttccatcaaatatgtcaagtctgaaaaaaaccgaagacatgtcttaatcaaatttgtagtctcatcagcatggtgccctgctcattggttacagtcgacactttgaatcatggtcattgagaaaagacagagtgggcaggaagagaaagaggcaaggaaaaggaatgatttaaggatttctgtggaaaatgttatttcaaaaaaatacttctgaggttaaagggaagcagaataaaagactttctagttaccagtgaagtcagagagacacaaatatgaatcctgctccttcctcatagcagctaaatgaccttgggtaagttcctctctgcacctcagctgttttctctgtgaaatggggttaataagagtatctacctcacagggttattgtgaggctggaaggagctaatagctgaaaagcatttagcacagtgcctggcatgtaagaagtgttcagtaagtgaggtatttatcaagaatcaaagctgtggcctacttaagatggtactatctgcaaaagtgccagccttaaaaaggatgtgaaaactaaaccaatttagaaaaaatatcatccttttaatattagaattatacataattctgaaaaacttaagattaattcacaaatcaaaaaagcttgaagaaagacaaaaaaagaaatatggtatttatccataaatataacattgtttctatttccctaagaggggaatataagcagtaatattaatattaaaatggagctccaaattaatggaaagtattcatttccagagatgactaaaaatcagagattagaatttctgagctttgctgtagactatgcattttcctaaactcacagcttagccacccttttattaattttttgttgttttccttacttggatgtttgtgtttatgtgttgcatgtcatatttatatgatgttttaaaatccatttgatctaaacaactcagaattctcttaaaactatcaacgacgccatttatcagctgggtatggtggctcatgcctacaatcccagcactttgggaggttgagtgggaaggatagcttgagcccaggagttcaagaccaacctgggcagcaaatggagactctgtctctacaaaaatttaaatattagctgactgtgttggtgtaggcctgtagtcccagctactcaggaggctgaggtgggaggatcacttgagcacagaaggttgacgctgcaatgaactgtgatcgtgccactgcggtccagcctgggtgacagagttaaactctgtccccctaaaaaaatgtcatttatcaaatggcatttatcaaattacaaataattttttgtgcatttaaaatagccccaagcaagcattacttctcacgcacccagacaagcaaaaaaaaaaaaaaaaaaaaaaaaaaaaaaaaaggcatttccatgtatggctgaattattactctatgtgtaaatttgtcttaacattagccttatataagtatatcttttattgtaaaagctaaaagatgttataaattataaaagcacaaaaactgcctggcacgtcactaatctatggagtataagctgccattttttgagtgcctagaatgagccagaatgtgtagtaggcactctatataaattatctataattctcaaaataatcatgtaaagaaaatattattaatattgccatttcataggtaagaaaattggggctttaagaggttatgtgacttgtcaaagggcatgaggctagtatatggcagagctgagaaatgacggcagctctgtctaaacttcacattctcatccttatcccattgcctataatgcaatattaaattattattctaagtaatatctaataaactttagacaatctcaggtaaagcattataagtggattttatctgggaatgggatcacccatcatactttgtatcatattttataacatttgtatgtcagttatttatattaagaaccatatcttacctaaggcagcgactgagtgtgaattttatttctgtgcagagtagacatctaaactctcactgaataaatgaacaaatactacagatttgaaacatgccatggatgatacatgattcctgacacctcacctcttccactcctcacctactttcccatctccctggttaagagtgagttcaagggatggagaatgtggagacagtgtttgcagtgagaaatcctgaaaaagggagaccataccaatcactagggcttcatcatactactactttttccacagagacttccttgtctgcccctcctgtgatgccgccagtattctaatctccaaatctaacatctgtccttatcaatgtactagagtcaagtagattggcatactgaatgttgcatccaaaaaaaaaaaaaagttggaaaactcatattctagttcagtttccaaccaagacagaccaagaactcacaaacaacttttggcatgcactaaaatctgcccctttctaaataaattgaagaaaggcagtgataggggaaagagctttgacaaagacagtaaagagctctatgtattacagacaatagcttgcctaagtatttgaggttgtagagatggtaggaatgaaagattcaaaccaacaaattgaagggactccccatgacctagactaataagcagtactgatcctaaggtgatgtacgacaatttcaaattaaatggttttctgagcagaccactcctatgttatttaaaacagggtatatgtgcattcataaagaatccaaatcttatccaaaagaagcaaaaagctaaaataaggaaacatgaaaaggtttttaaaaccaatggacgttgcttaagtcaatctagagaataattatgcctagaaattgtaacaagctatttcctatggaaataaatagattaatgcttcgtatttatccagttttcttcttttaaaattcattcataggcgttcatagagaaggaacttgcagttgtattgcaattttgagccagtgtgtcatgtgaacaattcaatttaggaatatactcatttagggaattaaaaaagcagaagttaaatttaacccagaaaattaagaacattatctctgaaataacattttccaaagctaaaaatatgccattatgtttattgagaagtgtttgatttcaaccaatgtctcaaatggttaccttatgcttcccgtgttattcattttattgggaaatggatgttctattcattgtccaaaggcttgttgagttctctttctataatcctcaggaattcaaagaagcctgtgagtcatcaaaactcatttccaaaactgagtgtgaaatttaatttcctagagattaggaaaaatatagcacatatctttggtctgtaaaactctggatgtaattttggctataggcaaagagtggcttaagtgacctttgaagaggatttctatgtgtacttaggatttagcctccaagagtcggcctactcagcctcttttgaaaagtattactgaggcagtcacattttagtcagtaaaatgatttttttccgaacaagttgactgctttcagaagtaggacgtggctttaagttaacaccaggattccacgttactaaggagaggcctcgatatgtctgttgcatccaggtgggctactccctgttctccagtcacgtctgtatccagtaagagctttccaactctttgtggcttatctaatacatctacgagaaaccagggagggttttaaaagctggcagggcataactctcacttacggaaggtccacaccccagccttatttttaaggccttatctttgatttcctgaaggggtggagctctcacagccttgcttttgtgttcaacttctgacttactccttgtgcacctataactttctattgtcaactgaaattacttgggaatcaaaggggtaaattgttttcagcactggataaagaaatttttgagaatgagaactttttctggaagcattctcctgcctgctcaaattttgttcctcaaatatgtgcttgctgtcataaccatgtctctgagcctccttaggagccaactcttgacagctaaagaaaaaaatggagcaaagagagcaatcttcctacagccctcgctgctgggggccccacccttctccatcgttcaacctcaaaaacttggcctcatctgtgaccctctcctgttctccgcaggctctccaaggcctgtagatttttcattatggaaaatggctctgacccattattaagcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctcttgtattgcaagaactgaaaaagcctttactatggggaggagttaaagtaatcagtgtcccccactataatttggctgcagaaaccccttctcccccaaaagcaatcaagagtctgatactgtgataatgctggaaaatgctgatgcagagggaaaaacatctaacaaggtgattccgatgattttttgattctgacaacaacatgcatgatattctcagtcacaaagcctctcagtgctcaggtcactcatctgtaaagtggggtactctaaaaggtcactttccatttttactttgacctataaggagggatgccctgcagaagacaggtcttcctgttagctcagccagtggctttcttggtccatttcaagggcactgttggaggggtgggagagacagcacttctatcatgccaagctaaatatcctgagaaagatcaggggttttctattataaaatataatagagaccttgacatgaatcctcattctgtgtacagatgttgagcccacactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggccccttcaggcacaaacatggattgaacctacgacatgccaagcacctaccgagagctagaggtagagtcactgatggttacgcacatgctgttctttctgaatgctctgccacactctccacaaaatggagctgagatgcctcttcctccaggaagccttactgagcttcacctcctctcagtctggattatgtgtcctacccacccccagttaaacagttccttccacagatatcaaacattacccttatattcctacatgcctgcctccctccttgagggtatctctgctccttaagtgtgaagactaattccttaatcttcatttcctcagcatcaattgtagtgactgccacataggaagtactcagatttatgactgactgactgactgaatcaaggtatgaaaaaccaattcctgctctcaaagaccacagagaatctagttcaacttttctacatgactttaaaacaatttataatgcatttatgatgctttaaataaaaatcgcgtgaatacttccaaatatttttgaattataaacacattttcaaatttgcctttcattagaagataccaagaaaaaaaaaactgcctttcaaagatattggataatgttaaaatgttggtttcaaaatcacgtatggtccaagataccaagaaaaaaaaaaactgcctgtcaaatgtattggataatgttaagatgttggtttcaaaatcacgtatggccccatgcagagaagggtccagatgtaagaaagactaaaacacagctaagggagacaagcacttatgtctacttaaatcggcctgctttttcaggctgtcaactctcccaactctgcagcttccacatgccttgttaatgtgaggagaaaccaatgtgagacaatagcagtcatatttccagtttaattacagaaatgcaaaccttacatctccttaagcctcaattataaaaaaaaatgacaaggcacatgccatgttttctctgcttcttgtcaccaaccatcttgccctattataaacaagaacactccatgagtattcagagtataattctaataaactgctctcagtctgccagttacatctgcagaacacagcaagaagaacttttacgaatgtagatatagtagggtaggaggcacatgaaagagagttccagcttcatcagagcaaataacctgcagagtgtattttgataatagtcacataccatggaaaaaacattcaaaaatatatttatttttccttaaagaatgtaaacaggtcagctggctcgtacctctaatctcagcactttgggaggccgaagcaggaggatcccttgagcccaggagtttgagaccagactgggcaacatagtgagaccctgtctctacaaaacatttttttttttaattagccaaatgtggtggtgggtgcctgcagtcccgactacttaggaggcagaggtgggaggattgcttgagcccaggaggtcaaggctgcagtgtgctatgatcatgccactgcatgccggcctgggcaacagagccagaccctgtctttaaaaaaaaaaaaaaaaaaaacacaagatgtaaacagtaatatttctgtgctcagtgtagaagtaatcttctcacagaaatacctaatgtagacgacaggttgaagggagcagtaaaccactatggcgtgtgtaacaaacctatgtaacaaacctgcacgttctgcacatgtatccgagaacttaaagtataattttaaaaaaaggaacctcctctcattaataaccagcatatagaatgctgagctacatcactggatgctaatcaaatggattaaaagccctagcttatacgacattcctttagtgcacatcatcctctttaaggagagtacagttgatggcttctctctcccccttttcatctttcctgtttcctaactttagggagacgtaagctgctaggaagacagatcattgtttttgagttgcatggttcctctgtgctgccagatattttatcctgatgtgtttgtataaaaagggataaagggaaatccatcacaaaattattgttgctcagtgaatgccaaacaatacatgcaactgaaggaaaaaaaaaaaaaaaaaaaaaaaggtggcggtgctggtggtgacctagccctcattcctgttatgaatgggaaactgaagaaaggttaagaaaagcatttatccatccactcatccacccattcattcattattcattcaagaaaaaaattcagtagctatttaaggtttttagataatttctcaaatgcagataatttttaaaattaaaatctgggcagattaagacaaaaaaaaaaaagacccaccacattgtgccctatgtttaaatatgttctaaaaaatgtccttgtagaaacatctgcagcccacatagacattttcatagacatcttgacagcaaaagaacagtactatcgtttcaggtacttaggaacataaaaggcagtgaatatatcagaaatctctcaaattttgttttttagttcattgaagcatcaaggaaagaataagggatttggagtaagaacatcttaattttaaaacctaatccagtctaatcctatttattctctttattttgtggagctgaactgaggatcaattaaattaatgcatgcataaccatttggttcttgcatgtagtcattcacccattcaattgattgattcattaattcactcattcaacaatctgtacaatggcctaggtacagtccaaggtgctgctaggattctaagtttgagaagaaacaggcaagactcctactctcataaggttttttgtctattaaacagccaggggctgataaacaacaacactaatgaatttacaatgacacactgaagcgtgcactctgaaggagggatatgcttctacaagactgaaggcaaagaaccacacaaaaacagggatgtaggaaggactttactgagcaggagacgctttgtacctgagaggaaaacgagagcttactgggagaaggtgcgggggtggatgggggtggaacggcttgtgcaaaaacctcagaacaggagacaacacggtgattggaggaatggaaagaaggtcaacatacaaagctgggcagaaaagaagtgaaagtgaagctgaaggtggggaaggggtatctagcacgtacgcagctattgagcacttgaaatggggctagttcaaaatatatgggctgtaaatgtaaaatacacactttattttgaagactgtgaaaaaatgaaactctctcaatttcatacatcgattacatactgaaatgacattttggacattttgggtttgataaaatacattattaaaattaatttcacctatttatttttacttttttaagacgactcctagaaaatgtaaaggtacatacatgactcatatttttcttggacagtgctggtagtaagtacatgcatagccttttaagtgtgaaaaagggtttttgtcctgagcgcaatgagaagcattgggaggctttacgaagagagacaatgggatcttcgcagcttctgggtagaaaagagatcaaaaggcacctggaggcaatggagaaaaatgatctgtgtactgcattataacagtttggtttagggtcaagaagtagagataagaggagtggaaggatttgagagatatttaggaagaaacacatcaacaggctctagtaatgaattgagtatgttactgagaaaccccaaagggcagaaatcatgttgggaaaacaaagatacagagtatatggaaatatacaatttaagtcctataatagaggcatggattcattgcagtaggggtacaaagtaagaagcaagtgtgtgctttacataggataaaatattgctgctgcagcttttcaggtaggcttcattaaaaatcaacatctcatcaaaaatatgcattctggttttaaatatcttttacccagagtttaacttaaaaaaaaaaaaaaaacagatacataatgagtaacggctgtgcaagagtctgtggtagggctgctcttgaaatggaaaagaaagagaatgtttctttagtgcccactggcatgtgccagaagttttaagtgtttaatttatttaatcatcccaaaaaccttacaaggtcatgttactatccccattttagaggtaagtaaaatgaggctcaaaattgattgaagttccacgaagacagaaaccatttttattttgcccctccactctattcctaatgcccagcacactgtccagcatatgctaggcactccgtaaataaaggttaaaacagctcccaagaggtagagccaagtgccaaccttgcttatctaaatttgggatcatcatgctaccatttgtttttttaatatattggatagcaagtacatttaagttaaagctttttaaaaatagaattaggcatagtttatatatttatatgtggttaggctaacaggtatttatataagagccctttatctgtgacaggtggttatcctctaccttattgaataacaagaacagttaacacttcctgagaatgtactgtgtgccagcctgttctaagcactttgcttgtattatttatgcctcattctcagcaaccctacaggatagatactatgatttctctcactttagacactgggaaactgaggtacacagagctgaggcatacagaggttgagtcacttgcccaaggtcacatagctgtaaaggcaacaaacccaaggaacctaattttagaatctgcatcacactctcaacccctatgagacagagcccactactccatgagactctagttcttacaaagatctctctagcattagggcaaggtctgccctcttgccattggtccagcaccctctgctggggccacacagtgttgtggtttatcagggcacctccttgtaaatctagaaaatcattcaaggataaattgtgagtcagacatttggagagtcagaataaaatgagcacaaaaagagcctgtagatctcgtgtggatctcattccatgaaaagagcaaacttaccctgagtctttaaatgtccactagcaggaagctatcatttgtctatggtgacatcagatagagtagagaaaagaggtgaagaaagggacttagtaagttgaagatttcccaacagcagaaaccatggcattcgggtgttaacagtgaattcaagagacccttgttcatgaatggagtttaatggctaagatactctctaagcacactaggcaatcagtgcttgctaggagttcacataatgaacaggatggttacaaccagacatccaggcatttgatgtgtgccggttacttcaagtgtcaaattacttacaagttttcaattgtgatatgtaagagggcttattgctatgatttggaagatcagttgggcacatgtgggtctatatatgaacacttcacttcttccaatactttaaaattgttatgcacattagtagagctcctgaaggagcctttttttttttttgttttggaatagtcttaatattactgtaaacacttgagaacatgttcagtatctggccatttcatacaaagggacctcatctggtgccccatcaagacaatctgaagtgcaatcaagaactcattatgaggtggtctaatctgtagggtacctcactgcctataaactaagagcagcacgatgcttctctactgaatgatgtcatctgcagtcactgggaacacacggaggtagaccaaatgccctatatggtaagtggccacacgtatcgggtaggaaggattgcctctgcccaaattctaatataaatgagaaataaattcatttacaagagaatattatgcactgaaatgcataatttttcaataataattatgctagatagtcagatgtttatatcttttctttccttttttttttttttttttttttttttttttggagacagagtcttgctctgtttcccaggcaggagtgcagtggcacaatctgcctgcaacctctgcctccgggttcaagtgattctcctgactcaacctcctgagtagctgggattacaggcatgcaccaccatgccctgctaatctctgtatttttagtagagatggggtttcaccatgttggccaggctggtctcgaactcctggactcaagtaatccacttgcctcagcctcccatagtgctgggattacagtaatgagccactgcgcctggcctacatcttcttataatgactaagtttggaagtaagagaaaaaattgaaagccattctgtctaataggtactggaaaatggaaaaagaaaaaaagaaaaaaaaacttagatagatagattccagggacacaaaaccagtgttagcataaataatgacagcccagatttatttgtacttaaaaaggtatacaggtaaataatctcaatttaaagtaggaataacacttgcaagacaaattaccaactaccaaaataaagaaaggaagaaagaatgcatcattgtgctactattttttaatatatagggtagcaaattcaaaatattttaaaatgctacaccacttaccatttaatcattaataatacactatgttaataaaaatgatatatcttcatgtgacaattacagttgcaaatcaatacagaggtgttgtcttggtgactcaaatatcacaaaatgttgttgccttgggtgggtataatattccaaaattgggaataaattttggtaagtttataaaccaaataaagtataatctttcctcaatttacatcatagttgcatccctcaaacatttagtacaaattaaaacattgtaaaaactacatctttttgtacaagttaaattctgtgttctcataattataaactgaacttgtacttctgtggatttcttgggaatgctcagagtgacctagaactcaaagaaattttttgttatttgagactaccccatgcaatacagtttatctagccccttagttctgactaaatgtcctttctgttcctcctcagtccctagtatgaccataacatgtccccataaatatccataatcatttccccaccacccctagaaggtactgctttcattcaggactacagcttacaactcttttgtatcaaatttgtacatctgatctagaggaatgaaaaaggttttactactgaaggttggtattagatgagtcttataatcatttttcaccatataagttaagctcagagataagattcattcaacatgctttatttttttaatttaaagttaaagctcattgacaaaagactaagaaacaactgataataaaaagtgcctcctctccctttttctgaagtggtttctaaaagaaccactgcagggatgatgatgatgatgatgatgatagcactaacatttacttaaacagttattttgtgtcactactaaactatgtgctgtaaatgcaagaaagctacaaaacagacctccaaactcacttgtggagcacttgtgaagattagagatgatcaatgagaaataaactggcacatggtaaatgattaaaaacaaaagctatcattattattaaatcccaagctaccctgaagcagtaactcaaaaaaccgtgccttaccattatgtcagttgttcagtagttatttatttataccacagacaatatgtttcttaaaatatgcatgcaaataagcccatcagagcaaaagacttcctttaaatttgcccctttgtggcaggtaataatgacatcgcctcgcttggatgattaataaccagttgttatgaggactgtgcctactgacgcaaatacagcattgtatttgggccctgagttataacattcatttctttaaggctgattgactctgaacagtcacattatttgcttgttgagtttacgcaagacgtttttccaagggaggtttatttatttatttatttagtggcatttacatgtgtgcctctgacttcggggagaaaaaaatgaaagcacaatgtaagtagtctaaaaaaagggctaatcagaataaccctggatgttttttcaccatgttacctctgtactcatatcactatagccaatttttaattaaaaagcttttattttctttcaataggatagtaaaaatgtgcaactgcctgataagtatttgctcttagtatagcacacttttcagatatttttaaagaagtatcagataattaaaacaaaacatataaaaacatatcagctgatattattttctcaatgctcagtatatgaattaactgatgggaatatagagaaacaaaacaatttagaagaaaaatagctcttaagccatcaagtttcaaacatttcaaactcactggaattgtgcaatcactacgagtttgtgtgtgtgtttgtgtgtgtgtgtatgtttagggtaatacactttattgattcattaaaaatgtaagtacagtaagctggaaagtatggcaagtaaaacaaaaaaaaaacaattagaagatttctatgaaaactttacaatctaataaaattgaatcctttttttttgttgttgttctctccccaggcaattattttgctctgttcacatgtcttcacaaaatactttcaattttatttttccaccctcagataaacagattccttttgttcggcagatgagaaacgtaccagctgttagtactactatatccatccatttactaatatttaatgagaaaaaatttaactccattttcagcctttctttccctctgctcattaaagagaagcctgccctcctggaaagcccttacttgtcagcccagttcttgaattatttttaaacagaaagttaggagaaaataatacagtgatgaggataagaaagtgaaagtgctgcaatttttttttcttttaattttttttcttgagaaatgacagggaacagctttggagtgtgtgcaggtaacagatggaagacaaaaagagggattttaagatttgttgctggggcacatgtctctctaatcaagaaatcaagtaaagaactgagttattttatggtattattgtattgcatggcatgtattctttcaaccctgatgcctctctgggactggcccacactggccatgttctccatgagttatttatggtactttaccatttttagagtgtatataaatgctttaccttatttgaacctctgaaaaccacagggtaggcaggaaagatattatacccacattttacatatgactaaaccaaaaaaaaaaatgaaagcgggacaagaattcagactttctaccatagaatttggtggtccttctatcagctatacattgacatatcatatttttatacttaatttattgtgcatttgcttcagggctatatctttacacatccaaacatctaaataacctgtagaaaataaaatcagtgatttatgtgtttacaattatccgaatatttggtattcatatataacagagaaataattaactgcccatttcacttttcacctaacaatctataccttctgtactcttagaagtaacagcactgctcaagaatcactacggttgggggcaaggtgaggggctctgaatcccatttggaagctttcttcagaaatattgcttcttgtgcagaagtcatgggtcaggttttctgtttggttgatgacctgtctatacctacatttacacacacaaacatgtcattcatttgcatttaacttgtcagtctaaaacttgcttatttggccaggtgcagtagcgagcacctataatctaagcactttgggaaactgaagtaggaggattgcttgaggccaggagttcaagaccaaactgggcaatacggtaagatctcacctctacaaaaaattaaatatatatatgcatgatggtgcatgcctgtagtcccagccactagggaggctgaggcaggactgattaagcccaggagttcaaagcttcaatgagctataatggcaccactgcactctaacctgtgtgacaaaataagaccctgtctgaaaaaaaaaaatcatttttaagattaagaataaaaaaatttggatccagagaactaggacttcattcttcttctgtacattatgagctacctgaaaactggtgatgaatatgcttcctttatctctacattctctatttgtaaaatggggataataagagcacccacctcataagggcactgtcaaatgggctaatacacatgagtacttagaacaacatatagtatgcactcaacaatgttaactttttaacattattaagttttattatgttacagttgctagtgcttgctaaaatagtgctgacacatggtagtcacaaaataagtgttattgtggtatatgttaaatgaatctcagttttgccaatgtgtgatcttggaagaagttacttcaccagaaaaataagaatataaaacccacaataatgacagctgcctgacaaggctatcgtgaggaacaaatggaataatatgtcagaaatgctttataaattataaggtgtgaaataaatgctaattaccatgtttgttctctaactttatcctcacaaataggctgttctgtagatgcaattatcctcattttatagaggaggcaacaggcttaaagaggattatataactcgctcaaggtcatttagatggtttggaggaaaacacagatcaaaaatttggtctttttctggccctttaactccagtaccttctttactatctctgttccatacagagatatgatctccctacaatgttatttctgagtattcttatgcttttttttttcacaaatgccatttgaaaatgttgatgaaaatatactttacattttatggatattttgccatcgccaagaaatttaaaaaagagaatgtggcagcaatcccatggcagcaactaacaagttgaatcaatccaacatcctctgaacaggatttcatctttagttttaggttcggtatattaaaagcaagcatcttaaaattccacctgagattaaccttcagcatctgatttttaaagttttgagggtgtggttgtcaaaaaaatgaattactgaggttctgggtgatttcatagggatttttcataaaaaccaaagagtcataagatcttcctagagaggccagcccccaacctgccagtgtgctgatccccaaagacaagctgtcactttgcaaaggattcatactaactcttgcttaatcaggcagatggcatccttgttctgcctcctagtctctgcttccatttgtctcctagacatcaaatactgagtctatagttcagaatcttcttctgcctgtgttccctagtcaacctggaattccctgacactgactgactgacacctttacatccattgtgctataatattctaacacttcgctgatctttgctgcaccctctgcatccatggtatcgctacacacatcccttttttccccgactgagttacctatatttgttcctcctctgctcttttataataagtattggtaaactgtttcttccaatagaaacacaatgtaccaaactatacagtaagtattttccttgccctattgaaaaccgacaacccactctcaagtgagacaaacgtacatgtgtcatcagtgtgtgctgctccgccataattgttcgccatctcatctagatgcctccagactgtcaatgaaatctgaacatgtgggtccaaaatggaatctaatactcaagctgtggcctatccagtacaacatgtagcgagacaataatatctcaggatctgaatacaccccttctgttaaaatgcagcctaggattacactagctttgttcacagccacgtaacaccactgactcacatgaagactgaagacaacacaaccccccacatcttgttcacaaaaactggtagcatgccaggtcttccatatctttacaggacacttggtatttttcaaaaacttaaattcagtccttcatatttctccccactgaatcttaaacctttggtttaggtcaagtgtttcagcctgttaacaacatgttgaatttttaatctatcatgcacatttacatattcctcccaactttttgtgatctgtagctctgattaagcagttatcttgttgcttcttttaatcattgataaaaacgttaaagatactaaggataaatccctaacactttttctaaggaccactcatggtttgatggtgaaccagttatcaaaactttttgtggatgtctaactacagaaaattcatttcaacatctaggccataggctccctttttatttacaataatatcataaaagattttcccaacgcttttgcaaaaattaaatttttaaacaaagttatttctttagtaaccctaccaaaaataaaaataaattcatttcaacatggagttttaatgaacctattttagtttcttctgaacccctaagtctttcagttatctgtttaatgttttgtatgtaaattttattgggaggaactgggatttaccactttttatttacaagaattgggatttactgattttatttaaaaaaacagaattatcttcctcttattaaaattgataaatattttcaattactgtgttttttaaaaacttttaagttcaagtggtacaagtgtaggtttgttacacaggtaaacttgtgtcatgggggtttgttgtacagattatttgaaaacccaggttaagcctagtacccgttagtcatttttttctgatcctctctttcctcccgcccaatatgtgttgttcccctctatgtgcctgacttcaaaccatactacagggtgacagtaaccaaaacaacatggtactggtacaaaaatagacataaagaccaataaaacagaatagagaacccagaaataagaccacacacccacaaccatctgccctttgacaaacctgacaaaaacagcagtgagaaaataattccttactcaatcaattgtgctgggataactggctagctgtatgcaggagattgaaactggacccctttctttcaccatacaaagaaactaactcaagatggattaaagacttaaatgtaaaaccccaaactataaaaactttaggagacgacctaggcaataacattaaggacacaggctggggcaaagatataatgacaaagatgccaaaagaattgcaacaaaagcaaaaattgacaaatgggatctaattaaactaaagagcttctgcaaggcaaaagaaactgtcaacagagtaaagagacaacctacagaataggagaaaatttttgcaaactattattgcatttcttaccactttcacctcgtcatcatctgagctggttgtttctagtgtgtctgcaacctcagtgttcagggatatgaaaaccattagcggaatacataaagcattaagttggaaacaagtatcagcacagaatctctcttgttaacatgcatgaacttcaagaattccactctaagagaaaatgaatagatttagcattgctaatgttaagagttctgtctgtttttcatccaccagttgtctgtggatgttttactgtactccagtcaaatcttagttgtttaaataatgcttattgggttgtggattagccagctctaatgtcctgtccatctatgtctatcagccatttcaatacttgttagtaccaataccatggagtacgcagggagcaacattctggcaagtaaactggattttctttagcagatcttgtaaatgtctttccagttaaattgttgagccattggccagagccaattgaggaatcatctgtggttgggcctgacagccaattctgagagcagaacaccatgaaaaagaatttcctatgaccactgctggtgtagaaaagaaaaaaaaccaaaaaaataaaaaaactgcttaaatacactgaagacataattcaaaatttattctttgtttttaatatctttgtaatatttctgtaaagataaagatctataaaataaagaccacagaagatggagagaagttgagataactgtaaaatcttatctgttgctgttagtcttagcaaacacaatacagggagacatggcattttaatagcttcacatgtgtaaattctagatgatctaggcaacagattcaacacacaataccagttaaaattaaggaaaaaggtctcatttctgtacgcttgttggtgagtcattcattgcgtgggcaggagtgatcacccttacagaatttcttctagaaccataacctcagttggtgagttctgagagctcagacatttttctagaaactaaacagggtacaggacaccagaaccctagggaatcaatttacatttccaacttttcttccagcacccacaccaccttctccccaacttcttatatagcaaaggctctctggtgcctcttttctcttttccccttcatcttgcctcagacttgtgtgttggcctcactttcctagtgttgttttaaagtgactttgctttttctcatgtaattgacaggctaaactatccttgcgtctaacaaaacatcctggaaaaaactgcatttcttagatatcttattcttatcagaatgacttgagctttctgccaaaactacatttaacttgaataatgaattataaaatatgttaaattgacaaatgacactaattcaataaatatattacaaaaaagcaaagaaagcctctactgtattcttgagtcagtatctcatgaaactaataccaactccagtattttacaatttacaaagcactttcatacctgtattcttacttatcagcattactaatactgtattactattatcatttccattttacaaataaggaaattgaaggtttattgaagtaactggagacactgagaaagtaaaccccaaagctcatgaagccaaggtcagtgcattttatttagcatgacttagtacactagttgctatttgaaggtacccctagacattcatttctataaagaccacctacatttcattttctgactcggggtacctaagaggctgtctctcttactttcagaaaggttttgctacatggggacaaaaactagaagggatcttttctagcaaaataatgcctaaggttcaaggatttcttagtatgatattggtggtccctggcccagcccctggaatgatccctgtgtgcattcatttcaggtgttcacaggaaagtctagatttagtacaggctcacattttcctttcagtgtaggggttaagattttgataaagtagaagcaaattgctcaagttaaatcccttcattgttgcctttcaaatatacattacagcttcagaaatagggtggactttaggtaagaagggggagaaaatggtgttaggcagaggccaggggcagtcctgttgactctcatggatctgacagggaaaatcagtagtttctcattgtgaacataggctttgatgtctagcaaagcttgactacaatgttaccaaggctcagggacctcactcttaaaacacagaagatgttagtgtcttctacctcttagggtttttgtgaggaccgaataggctaatgaaggtaaagcacaatacatagtcaacttgcacatagtgaatgctcaataaatcctagctcttgctattatgagattttatctgattttggagatagaacagagacacatatgtttaaagaggaaacaagagagaacaaaggtttaaactgtctttgagatgggatgtgcaaaattgtctcccagcagaaagagttgatcatatcctctggaaacccgatctctggcaggcagattctgaggctgtgacatcactgattcttgttgctgtggcagcagccctgcagccagacaatacggttttacaacagaaccaggtccccagttggtctcctgggccaggcactgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaaggacttaaggctattcaggtgtgtgtgtatatatatatgtatgtatttggaattataaactgtacattttgcataggggtgacttgattacagcaagggaaattaacctgcccctgaataggcctgtaaaggaaagaactaggtaaagaaaccatttagtaagttattacccaaatccagctttgttggtgataaagtgaaccaaggtgatggtggcagacagaataagaacaataactttcccagcctggcctgacacacattcaggcctgatacacacacaggctgtatcagcctggcctgatacagcctctaaaagattattctagaggctgatcccacatggtgataataaaccatttcaactgctttgtgaatgaccaaagatgacatatgtttaaggactttttttaagaattgagacactgaaaatacagactagccatttttaaaagtactcgtcaatatccactaaaaaggagccccttatattttcatcttccttatttaccaaagctagcttcatcagtataaactagaaaggtaattccagagtaataaatcttccatggagagctctctacctctggctgcttgataatgaatttaatcagtcgggagaacagccctgtcattatggattaatcaccaaagactgttttggtaagttgatgctgtgtttgcagctgatggtggtcacaagacacacttgatatttttaagaaatttagagattgaaggaatgctcagttaattaacaaccacaaaacacaacaaacaaaaaatagaaaccctaagaacagcataaacacagatattagtacctttggctttgatgaattcaagacagaattgactcaaaatattggtaatatttatcttcctgttggtttgtttggtttattttccaatccaattagggaattttaagccagtggattctggagcagggtgaattttcctaacaaacttacttacaatatatccaattagtaaagtgcagctcattttaaaaaataagcattttaattggatagttttattagaagaattttatgtttccttttcaacatggtatcaaataccataaagtcctcattaaactttcatgtatatgactccaggatcattaccacagatagaattaagtaaagttggctaagagtggtctagtcaattattctcctaaaagatattaaggatttcagatgagttaagacccactcccaaagaaactgaaacaagttaatcacttgacaactatatcaagttatatgcttaggctgggagtggtggctcacacctgtaatcccagcactttggaaggtcaaggcaggcagattgcttgagctcgaaagttgaagaccagcccaggcaacacagggaaaccctgcctctataaaaatacaaaaattagctgggcgcagtggtgcacacctgtagtttcagctactcagaggctgacatgggagagtcgcttgagcttaggaggcagaggctacagtgagctgagacagcaccactacactccagcttgggtgacagagcaagaccctgtctcaaaataaataaataaataaataaaaagttgtaatttgtaggttgactttttcaacagtatatttagaatgctgaatgaagaggtagactctcaaacctaaaattttcttctagaatatatttttttccaacatctttgtcattcctcttaagtttcactgattgcaatataagtttgtgacttaactgttaacctatcagtctagtatttgtggccaaccttaagcatctaacaatgtacaatttacattgtacctcaacggtttctgtctcagataagctaacctaagccaattttgcttgtcaatattttggtaaataatcatggtcacctgggattagagatagacagtagctatggtttgttcgcctacaatttcactatcaaacgttctgttctataaaagcaagtctcagactaaattctgctgaaccttccacatttgtttacaaacaggcacaaaatagacattgtaaatctgaggaggtctcactctctgttgtcagtcactctgacatttacctcataagcaatgttcatgcatttcagtcaagttcaaaagtggcgaaaggaaaagaaaggaaaagggaaagggaaaaggaaaaggaaaggaaagttcacgctgtggcagatgcaaccaacaaacaacaggaccaggcaaccatggagtcacttagccagtggaggccccagtgaaatgggagacaaggaccgatgatgctttgactctgtgtactaactgcctcaaaagtattgagcagctgggctagcagattctatatgtccttaatgcaggaggagtagggcttataaaatctctcctgtcaactaaataatctgaatacttgtaatttccaaaatggaaacttattccatatgtctattataattaccatgccctctattatgcaataggtagaattctaagatgacccccatgaaccatgaccaggtatataattctcttctcttgagtgggaacaatacatacaacttgcttcttatgaatagaatatggcaaaggtgaggggatgtcactcctaagactgggctattttgtatggcaaaagtgaagaaagtgtgcatatgtaattaaggtccttaattatttgactttaagttactcaaggaagagtttatcccgagtgagcctagcctaatcaggtaacccattaagaagagggtccagggcttcactgaaagaagaaactcaaagacattctccagttggctttgaataagcaagccaccatgaagtctatggattcgagaaagtgaattttgccaaaaaccacatgagttttgaagaggaccccaagcatcacataagaccccagccttggccaataccttgagtgcaggcttgtgagaccctgagcagggagcccagttaaacactgcatggtcttctaatccatggaaactgagataacaaacgtatgttgttttaagccactatatttctggtaatttgccatgcaccaacaaaaagctaatataaaaatatttgaagtgcttgaagtctcacttctgaattgtgtgcttcagatgccaactcacagccctagagcagagctcaaagtgaatctacacacacatgcaccacctgtttttttctcaagtaatttaaaatagatttccaccatagataataaaaaactctggtccacatacctggtcttagtctctagatacgacatcaccgagtatgagtgggagctggaagcactgcagatattgtttagtcttctcctgcctctccaatcaggtctacttctactaccttctccctgttatagatgacaaagtagagccctacaaagtttctgtggcttcctcaaggccattcagttgcagaataagactgaaatcttgtgtcctatggtcatcaattcaaaatgtttttatttcaccctgttgtaatgaagtcttcttattgtcttataatttctaccacaaactccaacttcatttcacaggttttaaagaaaattatcctgtactctttgtcatccattcattcattcatcaaatatgtattaataacctgctgtatgcaatgcgttgttctaggagctggtgataaatcagtgaacagaacagataaaaatctatgcctttatagagtttaaattctggtgaaagggaaataagaaataagaaaaaccactgaaatgcctagtatatttcatattgataagtgctcagggggaaacagtatatggaaggacatgggagctgcaatttcctggatttcaggaagatctcttgcagaaaagtgccatctgagtaacagcctgaagacaagaagggagtgagttaagcaggtatgtggaagaaaattgttccaggcagaaggatgaagaaatgcaaaggttatgtgtgagtagaaaccttggagtacaagacctagaaaaactgaaggaagcccagatggctgaagtagagtatgtgatggggagaatgggtctgacaggtaacaggaggccaggctttgtggagtttttactctcagtgaagtgcgaagctagtggagagttttgagcagaggagtgtctgggaaaatcagcattatttcttgggagtttcaaactagaaccaagtcagagtgttcatatagctgataacagtttgtacctttcctgtggaagagaaagctgcccgtcatctgcagagaaagaggaatgagtcagacacatggagagaagtagaggtcagaagccagaaagaattcagccaggtatcacacacatgctcctgttcctgttaaattcctattttggcccagcgaactcacttctctctttaaaatggccttgcccctcattttgctgaggttgagctcaatgccacctcctagagaggtcttctttgaccatattctaaagtagcagtatcaaacactctatctccttctcctgcctaagttgtattcatgctaggcatttatcaccactttacaatgcactatttatttgttcactgttttgttcccagactggaatgttcaccccatgagggcaggctctttgtccatctttgtcactgttttaccgccagtttccagaatagcatctggctcataatagatgccattttaataattttttagtgaataaatgcaaatacctaaaatccccatggttatttactccacttggaaagcttgttaaaacatgaattactggaccctctcttgagaatttctgattccgttttgaggtggtgcttaatcatttgaatctctaagcttccaggtcatgtccttgctactgatccatggaccacactttgaaaactactgttctatacctcgctagtttctgttacaattaagaagttttagctaatgtagatgacttgaattcttttttcttcaatttttcatatgatttttgttttcttccttcaaccataataagatgatacttaaattttgtcttaaccaggagatctataaatacaggcttatccatcccacttataagcatggcaaatggtgcttctcaaaagtgtcccccatgaaccctctggtcacctaaccgaagtcgcccccttgcctgtccttagcttgactatgttgtgcagccatttcactgaatctcattccagactaatgtttccatagccttcatgattttgcctttttttttttccctgcagagaatgtgtctgtttaccgcatcaccatcacctttgggaccctgtgcctttatgtcagcactggtgctctaagaggcttcttctttgctcattttcccagagccacattttccttggggcagcatcttcaaaacttgccactgaagtctcctgaagtctttctaaatatctattaaagttctcaggctaaacttaatgtaaaacatatactcacagtaaaaacttaatggctcactcaaatattttgccaatatggagccattaggaaagagctctagtaggtctcatactgttagagatgtgaaaattaataaaatactttaagtcttatttatgtcacttgataccacatgtcagcacattttctgacattatatcataatgtctacaatgaaaatcatggaaaattttggcttactacatttagcttgatcagtgctttgtagtttacaaagcactgtttgttgttctatctcaatagcaatgccaagaggtaaaccgaacaagtatccttgtactcattttccatatgataaagctgatgcttgaagaggtcaagggcttgaccccaggccatgctgatagacagcaagagtcacactcatatatatgccaagcatgcaaggcccttgccttcacagtctatttacaaaacagcctggaagaataataaatcaatcctaagaattgctatgaaatgcctttagcataggcattaatgtgcaatggatgtacagcctattcaatttcttcatgaatctctatagtcttcacaaggaactttcactagaaaaaaagacaaacttatctgttttatctcatttttttttaacaccaaggactatgagacagatgcaaaatcatttttgatttgttggttgaggattgactgaaatcattactaattattcggcacaagtgggttccaccagctgcacttgaagaacacttcaacatcctaaagcaaaataaagtagcttacggcaagtgatgagtgccttaattatgttattgctacacttactgcgatttcaaagattaaacttaatagaatttcctgagcaatgatggtccacactggatctgagggggcttttcacaaaggaaaaggagaaaatacttactaacctggctacagctagatctggcctccctactaaaatgagggttaccaggtgtcctacttcttcagggaatgtgctacttttcaacaaatcaccctgcgtatgggatccaaagtagggcagtaaaaatgtctggctttctgtgacatgccagattcttctcctctctctgactcactgattttccacacctttcagtgtccgagtttgaagtttttcttagactgaagaaacttaggattggtcaattccccaaacctcttcatttcctatagcagaatgtgattaaagaaaaatttccaccaaccaggcaagccaaattttctagattgtatatccacaacaacaacctcagctggttgctccaaacatcaaaatcgggggttggctgcactcggcaataccaccagccctgcttgaaatggtttactgcatgatgaatgctgaactgtcacctcttccagggagcctttcccaatccactacatgctccacccacccacccacatgcttggctgaaattaacttttccatttccctgtccttccacaacactccttatatacttctcttaaagtaagtataacaagattcctagtatcttagagattcctgtgggacaaacttcacaactcctttctcttctcacatctctccatgagtttatgaaccttcaattcatatctccagaacaggtttctttctcttcacttcgtcaaaattttattcatctcacagaattcaggtcaaatgtcttttacctggccccattcttcccatctccataaagttagtcaaaacttccttcatgatctctgataactatgaaatggacccagctgtcctatagaacagatgtttatggtttcttttaaataaacatagaagttgactctcccagtcttaaaacttgagaaagttacatttgtcttatctgagttcctttttcaggaaaccaaccattgggcctcctagatagtatcaaggaactgaaactttccagatcaccatctggacaaagagaagccacacccctcacctatcatgactgcctaactgaccacctgcttcctgttcaccaactcctcttccatacctctccctaattcctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcggtcttcaggtacatccagatggtagaactgcacatttgccaagggttagtatttttattccgtaacctgtttacatcacttttgttaccgtaatttccataatttgattaaatattattcaaatcaataaaatatgagtgttttaaaacagttatccctataagaaacaagcagaatgccttgtaagtactaataaacactccgtaaagactagtattattttcttttgactgcctgatttgatgtaaagaagacaattataaaagactgggcaaaatatgtatgaactctgcaattagattgccttgcaaccatctaaactgaaaatcgtatattataggtatggtttgagcaaataagaaaacacaaatttacaactggtggacctttgcttaaagaaaagctttaattgttctactaaaatagaagtgagtaaatgtacatttatatgttttagttaaaatagaatgtctattttaaaattatttaaaattcctactttgacattttgattaactaccaggaatataagagggattctattataattatgtctttcttggttgattcattcattaattcatctgaataaacacttgatgaatactatatttgcttttatactatttaatacacaacctgtcttatggcatttattgttgacatataaatgtggcacatagtgcttggcaaattaggtacccaatgataaaacactaaatgaatctggacctattatccctgctttgattttgttttttaatgatacgttctgttttgacacatccttgtattcaaaattggcaaattaaagattacagacacgttgtagataataaacataaatcatggagcaaagtttcatgaatttttcacatttttttgaaatttggagaggctattgtttgtatatctcacttgtcacttagtaacttttacataccggaacaaatttgatatatgttttttgtccttagttggacaacaaaataacaaacattatattttagaattgctcttatccttcgccatgtttataagaaacatttgacacaggaaccatcccaaagacatttggtgactgtcattcgcttcatattttggtagagagcatcactcaagtttagtaataaaaataataacaatgagcatatttgccatgtgacagacctgtgttaaataattatataaattatctctttctagatttacaactatgatagtactcactagagaagtaggtactaacagagaaaaaaattaaatcttagataaaaaaatttgctcaaggtcacaccaactaattaagtaatacttaatacataaacaagtattaaatattaagtagttgtcacttaaatccatttgatggattttgtcaatttatttggcaagacactatttaacaaaggtacagatccacagaagtcacagactgtggtatatgagatgcatacgtgtgatagggaaattgtcataattaatagcatctgtaaacattatccttaacagaaattttagagatacaatgtagtcctatatccaagagtgaaccttcagtcattcacagatctggtaacagggcatctgcgaactttacaattcactataaagtaataaatggtaagcactggccaggtgcagtgactcacacctgcaatctcaacattttgggaggttgaaatgggaagattgcttgaggccaggagttttacaccagccaagacaacacagcaagagcccatctctacagtttttttttttaacagttagacatggtgggcctgtagtcccagctactcaggaggctgacacatgaagatcacatgaatcccaggagttggagactgcagtgagctaagaatgtgccactgcactttagtctgggagaccgagcaagaccctgtctctaaaataaataaataacattttaaaaaatgttaagaattattaaactgttatttattgtattaactagaaactttcttgattcactctgtatgttattgagcacagtcttttgtagattgttgaaatttgatgaaaacacaatgagacagtctcaagcagaacagaaccttgcatcatgaatcatgggtatagaaggcaacattctctaattatctttgaaagaaggtacactatacatcaacatcatcatcattcaaaaagaacatagaagacagaactaaattcttctataaataagaaatggactcacttggccatcattgcaccacctattggtttctactatgctcatttcttcaagatattatagttgtattttgtcatgatctttggtggaatattttatattttttatttatgtatcagggaggttttgttaaaaaatttcaaggactggatgaaagcctttcgaaaccaaaaaatatttaaaaacctaatttctcattactttcacatttgggcatttaaaaatgtattagcttttacaattttttcccggcattttatcttctattgcaattattgtcttttctgtggtcagatgagtcaaggctttacttgtgtagattaacaactgttacttataatagcacttgtaatttcacaaggattgcataatcaaggtcaaatctctttcctaatgcctgccaccacttctccttaagtatatagagttcttctaaatctaagtgatatagtactttcttataaaatacatttctaaaataatcataaatgacatgccactattcaattcctatagtactcaaaaattcaactcttatagtacttttgatcctgtagtgatgaaaagttaattgcaaatagtacggtcattaattgctatcacctttttaagagcgagtatgttcttaactgtttctgcaaatagaagatgcaataggaataatcctagtctcgaggaggaaactccttttttctaatcaagttttataaggaacagtttttgagacatactactgtaactctgggcttttctccttctccttcagtgatcagccacacttaaagaaagttgtcttgaatactggatttaaaacattcatttattttttcctacctttctcttttaatctctctcaaatcaccatttttcaaagtatctgttttttggaaactgtatcaattgctacgaaaagacagaagtataaatataggtgaggagatttataataaacacgggataatgataataataacatcaatataatgtaaaagttatcatatcaacaaggaaaaaaatgtaccatgaggagcaacataaaacaaagtttaaactttggcaggctgaagccaaggaaacttttgaacacttaatataccatctttcaaatgtctttctggagagcagtttgctaaagtgtactaaaaaaagttttaaacttcatgctttttgattcagtaaatccccttaaaggaatctattttaaaacagaagcttggcaaatataagtgtaaaatatgtaatgacaatggtttttaaaattaaaatagtcctggaaattataaaatgtccaaataaaaaaaagtacacaaaatgataatccacttgatgatagaatattattccaccactacaaagatttgagaggtagaaagaacattcacaaaaatgtaaaccttctgaattataataggtgattttcatttttatctttataaatttttaaattctccgagttttctttattgaactggtattgcttttgagctccaaataaatgctactatgtgttttaaaagaatatctgatagcatggagtatgcttacaatacaatcaagatataaagtataattttaattttgaaatataagtttacatatgcccacggacaaaaacaaaaaggactgttaggaaatacgtggaaatcttaaatgactacctgttattaatacagctggagataatttatattattttattttagtttagatattttccagaattttataatgagtctattttactttcaaatggtaaatgtgtgtgtgtatataacagagcaatagaagtcaatgtagcggaattcctttccttggctcaaacctgaggcttcctctcagaccttgggacaaaggtctgagaaataatatgaggcttttacattatttaatctcaccaaagaatgaatgcatgaaaaataaagcctaaagctattttagatcaggatttttatttaacatcaagtaaatgaaaaaagagataatgaataatgggactacccttttatgatatacaaagcaaggtattgggtctaattacttgatgaaatttaaaaatcaaaaaaaaaaataaagggaaaacaatgcagttaagtttccaagtatattattaataaataattgtaggaaaagtcagtaagtccatatattcatgtacggaaacagaacccatgatggatgagcattggttactcctcattgctggaggttttataagcaaacaggccagttttcttcttttgtggctttgtgagttttgccccttgacataaataatgtatccctaaaataccatgaatgacaacaaactaccattttgtcttccttgtctatcttcagtatgtggtggttctactatagcagatcacttcaacccaaatattatctttaaactctccaatggtgtacacttgaataaagagaaactagaatatcttaagtaacttggatcctaaaattcacagagatcaaattgtacatgagcataacaacctttatgaagatccaaagaatgaatgattcattggaaacaagtatgttccaaaggctgacctcacagagcattggacctcagaattcaacctccatctctgtctttctttccttgtattttatttaggtttattctgtagtaatggtatttccagggtctacatctttacttggatattttgttcctctttgtgtgccttctctctagagaaatgctgcaagtatagatcaccaccttattttagcttcccattactgtggcatgtagaagagaagcaaaggagataacaaagaaattgatatattctattcacacaggggtaggatgggaagatacaagcttttaatgaactggctaaagtttccaaaactcaaactttttttttccataatttttgcaaagctaattgaaaccagatacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcctgtaatcccagctactttggagcctgagacatgagaattgtttgaacctgggaggtggaggctgcagtgagccgaaatcatgccactgcactccagtctgggctacagaaagagagactgcctcaaaaaaaaaaaaaaaaaaaaaaagaattagttgagactgatgggctactaaggaaatctctcataccagttaatcaatttagctactttgtatctcaaattggcatctctaaattgtgactgaaaagtatataatcccttttcaaagcaagtcatggtgaaaaatgttcccacttaagccaaataaacaaatgtttatgccactgatgagtagtgccccttagaaatcatcaaaacccgctttagggattagggcagaacatttgagagtataattaaatgcataaaagtgcttaaacttgaattgctacaaaatatagaaaccatttggaaatgttttatggatcacattaatgtgtgtgtgtccccgtgaaacataagatatatagttgttgttgcataatgagttctgacagcacgcttcctagaagatgacgttcatctgagcagtatcttacttttcattctacagcattgcaaaaagtgactaatgatagagaaaatactgaagagcatctcctttgatactaacttcaagcttctaaaccatgagaaggacccatttaaaacgttaggctcatttactgatgagagtggaccaaagaaaatcactctatgcatctaagcaacagtatgtagtgtcatcactaatttatgtcctttgggtaaacgttcttgttaaacacactggtttttgacaattttgttggaaattttctgtttataaatttcctcttttattcagaagcttggaccaaatcaaataacgcaaagtgaacaatgctcttttggtgatgtgcaaaacaaagagaactctaaaacattctgttaattttaataaacaacatgacttagaaaaaagtaaataaatcaaaaagcaagtagaatccaaatacccaaataacgggtgtgttagataaaactattaaataggaataaaatcagataagaaaattgcttaagaccttgagcctgctgtgaaatatttagtgaatctagggaacaaaggataacataatgaagctaaagtttaggaaacgtaagtgttcacctatcacactgtcttagaaatgtgtatataaatacatacgtatatatgtgtgtatacatatttacacaaatgtggctatatattttttgcaggtttttatacatatatttgagtgtgtgtgtgtaaataaagttcacagggatggcctgaagcttaacctaaaatatttctatttcaaagttgatcctatttataggcgtatttaacagagaggctatacggacaatttgtagagatcaatagttggctgtatagaaaggattttttttttaccctttataatgttgtgaatccctaatccccagtctcacggtaagtgtcctacatatttagtagagggtgatatgaacattcaattcttaaaccctttggtgccagccttaagctatcagtttgcaatatttcatatttacaatctaatctaagcttccaggattttcctcactctgaaagataaaacagacattttaaaatatgtatcattaattctaagttttagcaaataaaattgctacactgagacaaaatgtggttacaaaaatcattgtgtcagttaccaaaaatcccaagtctaccacttagactacttttatgtcccaccaataaaaactataaccccagaccatccaactgaatgagccacgaaaattacccccattcccatgttactgcctttccaattcccatgtcactccctttccaattcccatgtcagttgtgggtctcatacctaggtgtggggaagcaaaagaaagtttaaattatgagaaattgttttcagatacttttttttatgatggacacttaaaaatttggggaaatatatatatgatatatgatatatatgatatatatatcatatatatcaaagaaaatcaatgttataatcagccagtctccccaaatcaccaaagctaataaaatattttcttccaatttatagacacacacacacacacatacacacacagtgaatctggtattctaccaactaacatgttataaacattttccctcctcattgaaagttcctcaatcttcctttttctaatggctgtataatattccataatatagatatgttgtaatgtattattaggcaattgtaatggaagaaacattttactagaaaatctggattacacaacctagtcactgtagtaaagtaagagcattagtagaaactgtaattgttttagaagcttttagaagtgacagattcacctatcgtttcccgtactcttcaccgacattccttaaggagcagattctgttcagcttgcaattgtcacttggcttggaatcatataattatttaccactttttttttaactttcaattgtggataaaatgtttattaaatgaggctgattcacctcagctccaaagtctgtggcaatttctcacctgcttcctgctaattattctaaatagttacagaaacataattgtgattcaagtggttctccaagtagagtccctggaccaccaatttcagaaatacctgagaatttactagaatgtcaattcttgcataccatctaggtctactaagtcataaactctgaggatgaagttcagcaatctgtattttaacaaacctccaggttattctgatgccccctcaacttgaggaaccaccatcttatcctatagacagatcatgctgttgaaatgtgccattttcacatacacatagtccacagaggcttctgccatgttttttttaacaacccgatatgtaacttttgtcccagcaacattttaacatcaggggactgcatccatttcaatctgaacacttttgtccaatcactccaagtgagcttaagaaaatgtagagtaaatttttttaaaagatctgtgtacccaatttgatagacattttatcttattttggcatttctattctcaggtagcaaattgcctgaaagggcaaacaataaatatgggagctaccgcatggctctttgtggatatatttggaggcagtttaacatgctgtggagatgtttctagaaagattactgacaagatcaaccattttatgaaagttgcttttattacctttggattttttctaacttgaaaaatattgctcttaaagtatgcttctctactaatccttcctgttgagcattctattctccttaaaatatatatatatataaatatatatgtagatgcgtgtgtgtatatatattacacacacacatatgtctgtgtgtatgtgtgtgtgtacatatgcacactcacaaataattaagtaattccattctgggagaaagactttgaagaaaagcagtttatttgctactcagaaagggaaagtgatgttcgtgggacataaagggatttgaataaataggaataagtgtccttttaaaagaaagcagcatatggaactagaaatactttctggaagctctaatctcctatttgaagaaaatccaattgttctggctggtggcaaactaggagattacagctgaatttctctccctccattcaatgtgaagtaatcatagagccataaggaatttgacaggaaccataaatacttctcctgtaaatccctaaaaatttataagagcattatgactttcatgctctttctttcctagagtctttacttcaaagtcttctgagactagaagagcccctggagcaatcattctgcttccatatccacaacttggaactcttagtcccagaccctcaaattatagaacctgagggaaaatttagggggcactgaaaccaaataccttcacgtgtcagatgacaaaataaatcaggtagacaaaaagtgttaaccacatcacgcaaagaccaaaacccaaagttccacattttcaggcagagccctcagcctcatgtcactaggcttcatttctaccaatatcgccccactgactaaatgtcctttgtcactagaattgtttagttctgcataaatacaaagtatcgatgatcaaatttgacttatttcttctcattcagtccttaagtggaaacagcaaaatgctggttgccttctcttaaaaaaacaaacaaacaaacaaaataagaaggaaggagaaggaaggaaggagaaaaataaaaaagaaagcgagaatgaacaaagagtgaacaaatgaaccaacggaagaatgaaaaataaaagaaagaaaaaagaaaggaagagaggaagaaagaaaagaaaaaagaaagaaaagaaaaagaaaaagaaaagagaaagaaaaagaaagagaaaggaagcaagcaagcaagcaagcaagcaagcaagaaaacctaaagatctttatcatcacatttaaataagagtaaatctcaagaggccatcttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaaggagggctttcagcattaatatttacattaatgtttacgttaaagtgggacagattacactactttttactcacttcacttcttcttaccctgcatagagttaaatacttactgtttgtgccttgtaagaactctaaagattatagtgtactagtaaatctactttattttgctggcaggagtcagcagacaaaagaggagcaggagaaatgttgtcaaatcaatagtgatactgactgaattttatcagtgtttcatctttagctgaactatatgaactcattcagattttaaaaaatatgtaaactgtctaatctattttatagctccgttttacagagttataacatgtcaagaacaaagttacaaaatccaaaacatacaagttagcatcacctctatttttttctgaaaattccgaaagtacaatgattagaacacacttcaaacctcacagctctgtattacttaggaaaaaaatcccaacagctatccagttgtgctttgaggtcatttctcaaagcatgtgcattaagaaacttagcaatctatgtttatggttgctttatctggtagtataatacaatgaaaatctcacatataaaatttataatgtgatatttacaggttcaagggtggaattgctatgttccaaatgattttctgtcatcccttagttcactgtttctttaatcctttaaaacaatctgtacagcctttgctgtaaaagattattacattcttatttccactgtgtagtcataattttgaatgtactctctaatttaccaacattgtttccaattccatataaacccatatgagggtgctcccagcaaaactaattagggggataactgtgtaatgtgaaaaaataaagaattggaatattatccttgtgtcatttgatttgccaaaattcagcttgtaacaattagatactacagttggaaaattagtgattttatttatataacaggatctgtcataaaagagccaaactggcaaaatcactaatagtcataacctaaatcacccaatcaaccaaaatattataaagttcagcttttatttttatgcctattacccttttcatggcaatgggttatttcaaataccccaccacaagccctgagaacacagctgggttacttgaaaccagtagctctaaaccagtggtgacttgccccttaggtgacatgtgtcaatgactgaagacagttttgcttgtggcagtctgggggatgctactgacattttgtgtagggctcaggaatgctgctaaacatcctacagtagtgcacaggacagccccccacaaagaagaatgacctgggctaaaatgtcaacggagcttaaaaaaaggttactagtctaagtgagcttaagttgagaaaccctgcactaacattaagaactatgtgtccaacacggttgcaacatgttacgcaaacacctgcattttgtggggtggggggtgaatacagccattctagggagagtaatttgttctaacttgggtatttctgcccaataagctagtaagatatttgctttttctaacgtggattcatcagggcactgaaatttaactattttatttaaaatatggtatatactatttctttgtggtttttctgttagtgtgtgtgtgtgcgtgtgtgtgtggtgtgtgagtgaatttctgaaacagagcggtagcaagcaaatggcagatttggttttatcatcaagtttctgttagacatttcgataagattatacagagcatatagtggatgcctactacatatttattgatttttgaaaataaagtttgtgaacctatttctgctatcttcctctttagagaactgtgattgcatttttcttctttttttctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagtttaccttaatctacttacttctgagggtaggggaacaacaacaaaagcaacaactaaagaaacaaaaaccttttgagaagtctaaaagaagtagagaaatcctactgaagaaaccaacatcaacagtttcatttctttatcaaataaaaagtccggcctgagtctcctgactgactacattctttctagtattaggtaaatcagatctcaaatctgatctagccctgctattcagaccacgaattcctgtaaacatacctatctagaactgtgtgcaggcccctcttatgacaatggtctgtgctcacctggatttttatcactggcactcttagtcaggaccaccagattcttcctaatttctcaagtcaaatccgaaggctaccctgcttgtggtgttccataactctgtctggcccctcatgagaaatgccacctacttggatgagagcatttaagtcagagcaagacagcacagaggttgactttaggttcccatctgacatatttactgttctaagagaggaaaggtagtggaagagaaagaaaaactaaagtggaactgcaggatttctgattttcagaaatgtctgcttattatcagagtgataagaactcaaaattaagacatgggaaaggaaaagatagggatatagagtcagagctgttccttaaccaaaggctttacagaattagaacacagctgacacaggaaattcaatgcaagaaggtcctgctctaaataaaaacagatgaggagaaagtccattcatttttactaatagtatgcatggagaatgaacacacgctgccttttacatagacccttataactgttcatactgttctgtaaaatcagcatatttcttattattttcttctgggaaaaaacacttggctatgcatttccttttaatttcatggaaatgggaaaggggtaaaaggaaagaaagataatacttcctgaaaacttgaatgttttgctgaaaacacccttaaaggaatgtatctctgtcagggtaacaaaaacatttaataaaatatttttaaagcagttggtctctaagagaaaatgtgaggtatatgtaattagtagcaaatatgcattcaattgtactaagcatgaccattcttcccctttaaatcctcaatccatgaagtgtgtttgttaattaggcagtaacttgaagagcgctgcttttcccatagaagtcaggtgctcaactactcaaccatgaatctctacggttacatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtttcagggtttaaatctgcaatttccatggccctggaaaagtaatgtctaaatattgcttaactgaaagttgctgatgagaatatttcagtgctctgtgcaaagagtggatccgtggatcagttaattttattgaacagaaaaaaggtgaagtattgttgtagggattgaatgagaacagatacacagtgtttaaagtaattcctggcacatagtagatatccaagaaggtgtctgactccaccccttccttttctctctttctgaattgtattccactgtcagctgctagtgtatacatgtcatgagctaatgtgcccattgatggtttagcttatgactttcaggtcagttttctaagttgataaaaacaagcattatagataataaaattcagaggcagttccaacatggaataattggcttgtctcattccatagtcaaagctcatctcaactaagttttccattgctcacagtgaggactagggaagaggaattgctgcaaatccattttcacaggtgggtaatcaacacaagaagcactgtcaactgattgtgggtgtgaaaccatctacgcacttgaaagttttcatgttatcattactatgtatccacatacatttgccgagcctgaccgttccagatcagtcttctgaatgctagctgcatatcagaaccacatatgtatagtttcataaatgtgacaatactcaggccctaccctgagacaagtggcacaaagcattcagaagtggaaaggattctcaccaggagaaccactctgagaatcaatagaaacagagatccaggtcaaagaaaaatattatctttcttccctgggaatcaccagcatttgcacagacttctacaactagctacatgacccagggcaatttcttaaagtgggacacagtgtgctctgaatgcagacctgacactaaatttatcatggttgggtagctgctgccttatggagaatggcctgtgggacactgaacttacacattaaacagctgagccaacggatgtttcaactgccaggaaaataacagaatggggagaccctctgttcatttgacaccagtgccagcttggagaaacagcatttcttctgcagttattgaaagaaagtaacccagaagtacccacagtcttttagctcttaaaatatggagccactttttcttttccagcttatttccaatgcaaacctgattccaggctcaagagaagtacaacgtgccttggtcccttctccctagtcttggtcagcttcttcaattcctcttgctgatctggcctccagtttggctggctttttagaggagtctctcagcactaccagcagagtcttttgacctatgttactaacgcgtgtatcatatctagatccactcctcaccatatgtcatggtactgtcttgttcctggttattggtggtatatttgtttttctactgtatgtagttaaattttaagtaacttaaagaattacaatagcaatacaatttcattataaaaagcagaatatgtggataaacagaaagaagaaaataatatccactatcataccattaaggtgacccactaacacaattttcaaataaatttcctacgtacatattttatttttataaaaatgcaatcatagaatagtcaatatgatttttaaaagtcccttttatgaaataaaatatgtgaacatctttttgtaaataattattcatttgaaacattcttttaaaatggctgtatagtatttccttgtgattttcataaccatccccatattgatatttagcttgttttgaatcttctgctgttataaactatgctaggatgacagttacagctcttcttcaactgctactacccagtttgattgataaatgacacacttcccttggcctaggaagaagcaacagattctgatgtttgcaaaatttgtcagtgtggcttatcaagaaacagactctatctctctatttatctatcatctatatatttgacaaaacattttgaaaaatgacttttaaaaatgaaataaggaatgtaaagtcacaaacagcccagggacccaaatgagaaagcatctgtcagagattcatcagtcaggagtacctattattttaacattttcatggtcatataagaggaaagaacaggtaaaacagccaaagtatcacctgattcccactgatttagaacagaactgcagaaatgttgaaagattttttattagattaagcttcccagcaagaaatctagacagcaatctgcagctagcaacatgccttcggaaaaccaaatacgagattcactgacactgttttgtgagggcctcctctacccctcgtctcccctacccctcgtctcccctttttcacataccccacactaggatcagagaagtttggggaaaaatcaacagaaacaacacgccaggtagattatggccactgcaaccttgctgcagcttaggctaggctcttaggatgaccttctcaaaatccttgaaggagaagttggctgaaggaattttatgcaggtctggaatggtctcgtctctagaggtctagatccaaaaaataaaaagactgcaatttttaatctaactcttaccagaatgaaaaaccatctaaatgctccctaggggccttaaattgttatgttaccaaaaatgctatgctgtgggaaatactaatattaagtaaatagcccctgtcatttttaccaaggacatttgggggaaaaaaagtcactgatgaataagtgaaaccatcttaagttgctgaaactgacataatgaaaaccaccatctttctaaattccttagccaattaactaagggaggggaccacccctcatattgccttatgcccaattcctgcctccaaagaaagaaaaagtaaaaactaaaaggcagaaatgaaatccacaagcagaccgcccggcgccacaccctgggcctggtcgttaaagatcgacccctgacctaatcggttattttacctatagattacagacattgtatagaaaagcactgtgaaaatccctatcctgttttgttctgatctaattaacagtgcatgcagcccccagtcacgtacccgctgcttgctcaatcgatcacgaccctctcgcgtgcacccccttagagttgtgagcccttaaaagggacaggaattgctcactcggtgagctcggctcttgagacaggagtcttgccgatgcccccggccgaataaaccccttccttctttaacttggtgtctgaggagttttgtctgcggcttgtcctgctacgtaacaacttgtatcattcatcactacatttatttccattaacctatcctagaaccaaaagatcctagaaccgaaagatgagggtacataattgaagggaagactcacccaggaaagaaaaagaaaaggagtcagactgggctatctgagaattcacaaaggaactagaagctgtgtagtcaaaatgttcctggcaacgtggcaaatgtatttcaaatcaaaccatgcattcactagactcttcttttctaatcttttgttttctcttggcctgagtcaaagtcctttgtaaaactttcatggatcacatgaggaggaaaggggagaaggagaagcaggcagacagggaggaaatgagagggtgttcctgctggcaaactcagtggggaatgaactacctccttcagagggaaaatgaggtgggagggacagagagccacggaaagaaaggtaccagttcccttgcaagatgggggtaggagagggctcttctcagaaaactagaagagattttggtgatgatgtcagaattggagcatctgccttctaaggactttgtctgccaactggcatagggagcactgcccagagagccagttctccgtgtaataagcaaaggcaggaaatgggcagggagcagtaaactcagtgggaaaagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtcaaaaaaaaaaaaaaaaaaaaaaagaaagaaaagaaagctttgtgagttcttaatatgtattttttgtcacattaagtgaaaaaaaaaaaaaagttccccaaagtcatgaaaccaaagcagattctatttacatttagtgtaagattttgctaactgaatactatatcccaagtttatggggaactatctatacttacttttatatattgatcttacattttgggtgtgtggttatgaggttaattcattaaaatgagtaaaggctcttaatgattctttcttgactttatgggtcatgtgtctaagtacagaagttagtacacataaaaaactgtaattgggtactaaaaaatacatatacagattgccccatatctaattttctaactttaagtgtataattgtcagaggcatttgaagcagagcaactccatccatgaataagggctgggtaaagtaaggctgagacctacagagctgcattctcaagtggtgaggcattcttagtcacaggacgcgatacaggtcaaaggccttgctggtgaaaggatgtggtaaagaagctggtcaaaacccaccaaaaccaagatggtggcgaaagtgacttctggtcttcctcactgctgattatatgctaattataatgtattggcatgctaaaagacactcccaccagcaccatgacagtttacaaatgccatggcaacatcaggaagttaacatgtatggtctaaacagggagaaccctcagttccaagaattgcccacccctttgccaaaaactcaggaataattcaccccttggcatatgattaagaagtaactgtaagtataatcagttgagcagcccatgctgctgctctgagtagagagtagccattcttttattcctttactttcttaataaacttgctttcactttatgtatttgccccgaattctttcttgcacaaggtccaagaaccctctcttggggtctggattaggacccctttccagtaacacaactgtaggcttttattgattgaaacataggtgataaacagaacttcaaatttcctttgattttctgtcatggcctggattaatcgccacattttccctaattatggccatcatcttttccagtgcaaaagaaaaactcttcaccacgtctttctgcagagtttccacccaatcttgttttccatcacaggaaagtaaaaggaaagcttgcaagtgtctgtagtcatcattcaactactcaacttgactagaccatcatcacctactcctttaactttgtgctcagtaaactgtctctctcagatgaaagtcattgctattagctaccaacacaattgtgccatttgattttttatttgtgacttactgttccagagctgatccacagttaacgaaaattaaagccacaaatttttcccctaattagacatttgtgccttccataatgacacttacatacaaatgacactcaaatgtataagatgtaggctatatgcacaatacacataacgaacaccacatgaaacaattttggaatttaaatttagattaaattggtatttaaagttaatcctcattgaatatgaaacattaaaaaggcaagcttaaaaataccaagcaatttggcattattcagtacagcatgtcaattcaccttattcaaaagcaaaccttttgcaaagcaaaaattctcccattaaacccaggcattaagaagaaataaactcttaattacttaaggaggaaatgctctcgtttcatggttagcaggttatcaatgtaaacaatccagggagctttctcaatggctcctgtttcaagagtcccagcctctattccccattccccatccgccaccctctttctacacaacaggagctaatgtctttatgcgtaccaaaaaagacactactgaccacaatgggagagcttaggtatttgcccacactttccctgcaggagtaaattcagtagaaccctataattctgaaacagtcaagtcatggaccatctgactcattaaatattccaggcagccttgtcagtagtctggaagaccttgcagttataatttcttccctctgtcattcctctattaatactcagctaacttgaatttcaacatgagctttagactagctgaagaacatttattgtgcaagattcataaggtacagaacctattcatagaaagcattttggcatccaaaatatgtgtaactaataatgaataataatagcattgtctccgaaggcaagagcacaaaaatacagctatgaagcaaaaataaactcctgacagtgccatatgtaccctaaaggaaataagtaaaaagctttttttctgaatattagttgtcactatttcatttgattatttcaaaatgtaacttttcattaacttaggtttatcatggatttgcagatacactggtatctaatagagaatattaaccttagactatcaagataaagcaaatccatgaatttcagcatttttttttaagacatatggtctcactatgttgaccaggttggttttgagattctgggctcaagtgatcctctacctcagcctccaaagtactgaggattacaggcttcagccactgcacccagcctagcataattctctatagcttttacacttgtccaactttaatggaagaaaggcttctttgtacacaaatctgacaacatatctttttttctttagttgtgtatgcctatgatggtcaaactttggactattaacatttttattctcagttgcaaacactaagaaccattctacatttcctctgtaatgcaacaattttgctgatgccttcagtaattatgacaatacattttttgcaatagatatggtaatttgaaaagaacacatttaaatatatggttttatgcaacagctatcaaatatgtaaaattcaatatcccaagagtttgtgcatgttgaggaaagaaatccaagaaatatttaattaaactaatgaatcatcattttctcactggtcttccatgtgctgtatttattaagagagagaatatgggctctaaagaccattggtctgacttagggtgccatttctcgcattttcatgatctgaaagtaaaactagagcatttcggcagtttcaagttggcacgagtgcgttgcttcctagcttgaaatgcataattaaccagaaagctagttgttgagcagttaaacaggctgtccaaaaaggcccccattgctgttcaaatgaatgctgaaaagtagggtgccacagtgatttttttgttttatagacaagctacatacaagcaattgacaaagactaattttcctttcttttcaaagcccatgaaagcttgtgggtaatagcaattatttctatttgtcaaatacttgtatccagaagtggatttataatcccacgaaaattctgtaatttactgaaccactgagcaggtccatgctactccccctccccagccccataggatgtaattcatttcaacagaggattggagacaatgatgtaaatgaagcagtcctcacaaggcagaaggggaaaagtgtcaggggaacatacttcttaattcccataagaaataccccaattactggacagagtgccaaatttcagaacataaatgaatcccattcttattaccgagtggagaagatgctagggcaagaatagtggcttagagttagaaggagacatacacctacaattgctaaagcaatttctgcaagaaaaatttaaataaatatgggaaacattatggatcaaatccaaggaaggtcttaaatatatagtgctcaagaaaagtgcatgaatgtttccatacctcaaatatggtattttaaaagagcttgcctttaaaatacaatggatgtgtcatgatctaacagttgtccgcttttccagcacatccgactaactagaattcttgggagatcccatgccacaattcattttccaatttctaacaaagacaatgcacttcacatttttacttttgcattccagcacttacttgcatggtggtttatggttggtttgtgtgtgtttcttttttagaaatgttagaatgggaaaaatgaggtaattcttcaactgactcagtctttaatgattttaatgagttccagtgtttatgcttgagctaacaggtgccttatttttttccttggctattctttcttcccttgtcctcctattccgggcaatccatgcaacactccagctgtaaattattctgatggtatgaataagctttgacctgaaatcaggttagtaactaactgaaatctaacttacatttccataaatttgctgttttgaaaatgattagcatgactttgaaaaatctgttagctgaatcttcaaagactactataatcttcacaaaatcattttatgtaatatgtcttccatcactgtattctatacatacaacatcctctttctatagcactgaactcccaaattgtttccactagtggaaaaatgcagttaatattggattcatttgttgtcagtcacctttataaaatatacacacattcaaatgcacatggacacaggctccgcgttttaaattccgcattttctcaaaaatttaaacatatatgccaaagattatgcaaaatatgatctccctatagaacattttctttttgttaggcagtgtaaaaataatagaatgtatcactgttcttggagctttgtggattcctagactttgtaattcttcatgaatgcagagttatttttccaagatgctagaagattccccaggccattttaatagttctattattaaatatataataaacatgattacttatttattgtataatggatgtataataaataaacgtcagaaaatttcaaaacttctaaatgggttattgagctatcaaagtctgcagcttttcactatcagacaagtgagggtaggaaaatgggccatcacacgatctaaggtgaaggctaagggcagacggtatattagtaagctagaagaggggaatatcttcccaggtggactgataagatcagtgtggcagagctgtgggaacccaaggccctctgttactcaaggctgtgtgtgcagtgctgagaggtcagccatggaggaagcaacatggtcctgcatttcgatctaagcctacaatctaaccattgtcagctcaccccatttgtttcacgtaaaagcaatgctcagagacatctgcagagggacctaacttctcaaacttgccactttggattgaaaccgtatatgatatgcattccccctatctacgtcacatgcatatacatagcacagtaacaaggcaatcctctgtgttgtgttctcaattccttctccacagttttttttacttcatgatgacaatgcaaagagtggactgaggactaggcttaccaggttctaggcccagatctgcccctttctaactgtgtgatcttagtatgtcactcagcagatttgtgtgtgggtgtgtgtgagagggagtctcactctgtcatccaggctggagtacagtggtgcgatcccagctcactgcaacctctgcctcctaggttcaacagattctcctgctcagcctcctgagtatctgggattacaggtgcccaccaccgggcatggctaatttttctatttttagtagagacagggtttcaccatgttggccaggctggtctggaactcctgacctccagtgatctgcccgcctcggcctcccacagtgctgggactacaggcataagccaccacacctgacccaccagattcctcatggactggttccttgtctgtaaaaatgagatgatttattagatgctatctatacttccttcacttcttcaaacgtcagtggtttcttttttattggtagttttctgtcttcctgccttttgcctgtgtccatttttccattttcattttatgaatttttaatcctccacctcagtgaacagcctttccttccacaccaacaggtcctctgtcctgaaagaatatcacagctctatattggagctcccacagctcttggtgcactgcattttgattgctgtgctgcataaactgtcaatttctttccaaaaagacatcctctatcttgtttacccttatgtccccaacttcctggcactttgtgaatattcagtgaatatattttaaatacttgaccttcctaaccttttcttggaaggacccttcaggtaaaggagatggtcaagaggagttgcatttgcttttctggccaactctctttacaaggagccagcctcctgttcagtctcttctgaggtgacttttctatcctgtggatcttcactggtgactgtaactactaaccagtttgcatttattcactcacaaatgcagggacacacatataaccgtgttaggcatcacagagcatatcccataagtgataaagtcacaaatatgttacccccataacaagttaataatcttccagcatgccagaatgtcagtttagccacagaaacagccctatatattcttctacaatctctagtttcttttctaccctttcttccctatcacacaactcctaatgtagtttggggcatcaaatatagttcaatacatttttatgccaaaagtttcttcggaattgaaccagatacgcctgatctaaacttataccttcaaaagtctttatgttgttctctgtgagatacacagttactcaaataatcctcccaggcttaacttatcaacagtttgataaattagcttagactgtggatatcctcactgcagcacacctctgcagattcacacaaacaaaggccaatttggaagcactaagtgaagagattctctcctgtttcattttctccattctcctcctaaaaccacaggaaattttggcactttggacattccttttacacaagggacacagtaaaacataattcaactgcttgaatctgggtgaagggagacagcaattaggacagctttggaaaaataagagagtaacaagtaggtggcccaactgtgggaattgaaactacaataacagcttctaatgaacaagtttctacacagagaagcatgccttcacacacacaacagtggtaaaacagcacgaaagacctgtatttcgaaggggcaccagttagatatttaaaactcacgagtatggtcaagatttagtcatacaaatttattatcccttgcacttgactaattctgttatgctgaaagatagagcatttgagcacatttcaacttaagtattgaatccaaagacactgaaatagaaaaaaaatatagccataagaaccatagaaaaatggaacaaaagaaagataagagaaaaaaacaaaattttctcggtaactgtaactacataggaatgaaaaaagttgtaactatacagcgttttaaacagtagtcaatgattatatgtaaatattgtttttgacattacaaatataccaattcaagacagacctgtaaagtgctgctttttctgtagtcatttacattttgagacaatgagacaagaatacaaggtccttttctcagaacaaatttccctgcaatagtcacatcggtacagcttctggtattcatgtaaaagaacctattagttgactaaaatacccctgtaagttcccaatcatattttgttactagggtatattctaatttttttcctacgggaaaaaacaaatctgtacattcaggcttcaggaatatagttggagtaaagagaaaaatcaggatttctgccctgcattatggccaaaagataatggattcttaggctctttgtcaaaaacttcctactttacaattgtccagagcaagcttctggacagaaataaatttgaacccccaaagattcttaaattcacaaataatcagaaacattcacacataacaccacatcagagcttccatttatcaagagcaggtatgcagtcattccttgagaatactctaattcttacagcccaaactgcatctactgtatagcttgctgaatagaaaaagtgttggaggtggtggcatataatgaggctggagagtggaaaggaataagagcaatagcatgctcaaggttttggagttgattacagtagaaatcatcttgctcaaaatatagtgggatttatgcattccagtgccacatcatccaccattatccatctaaaacacagaaaaggcagtgagaatgtagtcattcatgtgtggtccccttgatcctgctttgccttcaatttcattactgtctgccaaccaaccaattaatctgaaaacttatcagtggtgctactgcatatctggcatccctgccccaacaaaactggagttctgtgagcgagtttaaaataacctagtgaataggagcaaccacggactaagagtgagaagggaaaaaaagggggaggggagaaggaatacagggaaaaaagggggcaacttctggaagcaaatactaaagaaaacatgaaataaaaactttatgttttaactttttaataaatcatggggcaagggatagaacacatgactctttgaagttttagacaataaatcttggaaatgggttgttcgattattatagtacccctccgagggcaatgaaaggatgtaatgaaaaaaatcaggccatcagaacaataaattatcctgacttaccagaaataccagcaaaatctttcaatatgacctgttactggccaaattaggaggaaaataacatccagcgctagggatcacattgaaaataatttcatttgattttcattaaaagctttccagatagtgactggtaaaagaagcccatatattctatctatagtttaatgtatatgagtactacaggaaagaagaaaactttagagataatctatttgcaaatatttccggggaaaaacaaaattgtgagattttcctatgatgaaaatatagtaattataattatttttaaaatgtattcttttattttttaaaaattagaaaaaatgttttacatgtataacatgatattttgaagtatatgtacactatagttaaatccagctaattaacgtatgcattacttcacagttatcattttttgtggtgacatgctatttaaacatatcttcccactctgtgagctcacctataagttatcttcaaaatctgataatacattgcatgtcattttcttattaaaaaagcattttcacataccttatcttgtgatacttaccatagcactttgagaattatttttgccatttatcagaaaagaaaactaagttcaggagtatataactaaattagccatgcacataataccagcaaatgggattcaaaatgggattttttgaccccaagaatgtgccctttctatagtactgcaatacagctgcaggcttgataaatgattttgaaaaataattaagtttttttagattggatttgattttggggccagcctaaagttgtatggcactaagactttcatacgaaataaatgattaggtaagataatgccattaggaactttgaaaaacaggtattatctatggctctgaagataatttcaaagggcattttaagaagagttttgaacactaatagttactattcaaatctacgcacatttcaaaggtaactgatttaaagttaataatagctagcataacactttgcacacagcatacactcagcaaatattagcaaaaacccttaaagtacttccatatataagcactggtaaggttttctaacaaccagtctcatcagaaaattacacatgcccattaggaatgtaaattcaggcagattctcttaaaatagctttgtgaaagttattataagccttaccatgtctataaattttggtctatttattccaatttgagaatttagcctaaagaactaatctaaaatgtgagccatgatttttttgctttctcaaaaatgtttactatgatattatttatgtataaacgttgtctttaaaaaaacctgaaaaaacaaaaacaatgtcaaaacaaaaacaaacaataggggcctcattaaataaattgtattcatttaatgaaataatacttagatattaagactttaaagaattttattcatataatgaaaacttctaacgcaaaccttcacaaaaaagcaagagtaaaacaaagattatacctgtacacactaaaatgtaaaaagtagccatctctggtttgtgaaattacaattttctccttgtcttttaaaaatttcttatattgggtatcctgtttttatacagacatctaagttattttataatcaataactcaacagtcaaaattgaatttttagcatgtgtcaggcatagttctaacctttttgtacatactatataatttacttttcataaataccattgatatagaaaaatttactttgtttttatacgtggaaacaggcagagagatattaaataactagcccaatattactttccaaataaatatttgacctgggtcttgaaccaaatggtctgattccagaactcatgttcttcatggcgttgctatactcttcatgttacacaggctgcttagcgatatgtcagaatatattaatgtcaaggagaaagtgatctcatgcaactgcgaccatgtctataaaatgttataacctttttggtgagatggactgatggtgtattaagtgtacttagcttacctcacatataactagttttcatgaatgtgttacttctccttcccgagaatacaaaagctgttttacatagagggatattacatctattttgtaatcatatatttacaaccatttatggtatattaggcactggattaaaagctggaaataactagcaagttatagcattcattgccataaatttaacactaccttggagtgggcatacggttttaactgaaacagattcttgaccatgggaatggaggcactaccttaagagcaaagagattcagattgtttccttgctagaacatgcttctgaggcactactgactgtatagatcaaagacagcacaggtaatgttattgacttcagaaattcctgctatattcactggctaatattatgtccacaaaaccacagctgctaaaattgcaaaggcatgagtcagtcatgacaataatttagagtattatcatgataagctcaactaggaagacaccaacctcattttactatggatgaaaactattgatggatatttttggtattattgattccatctaaatatcctctgaaatgctagagtgtaatctaggtattttttctggttatcattgctgatttttttttattatactttaagttttagggtacatgtgcacaacgtgcaggtttgttacatatgtatacatgtgccatgttggtgtgctgcacccattaacttgtcatttagcatcaggtatatcacctaatgctacccctcctccctctcacctcacaccagttagaatggcgatcattaaaaagtcaggaaacaacaggtgctggagaggatgtggagaaataggaacatttttacactgttggtgggactgtaaactagttcaaccattgtggaagtcggtgtggcgattcctcagggatctagaactagaaataccatttggcccagccatcccattactgggtatatacccaaaggtttataaatcatgctgctataaagacacatgcacacatatgtttattgcggcactattcacaatagcaaagacttggaactaacccaaatgtccaacaatgatagactggattaaaaaaatgtggcacatatacaccatggaatactatgcagccataaaaaaatgatgagttcatgtcctttgtagggacatggatgaagctggaaaccattgctgatttttaaaatgatctatttaagaatctttataagcagagcccttttttcttaataaaggaggaattcagaagttaataacattggtctgctttacatcctatacttgttttccctccaaattatatgaaagtcttatttcaaatgcaagtgaaaacattcatgtcctgtagcttgagaccttactacatataatatcactgcacagcatgatacaaattaacgtctttaagagggagctcaaaggcatacagaagtataagacatgccaagaagtttcatttaaatttcctttgttcataaggcaaatttttatatttactaatccttggataaatataacataaatacatagaaaaagaagcattatgttttcttaaactataggttgacccattgcaagcacatgatgatgcgtctcactaggtgtgcatgtagtaaaacagattgatttgccaaccaacagttaagaaaattaatttgttgagcatcatattttatactaattaaaaaagaaaatttgtaagaattatgtaagagaataacctaacattaaatggcaccataatggcatgaacaatttagaaacagaaagtcaataccttggtttctctaatataaatgtgttgctcatgctcttcaagcattttatgaaatgaaacatgaatcaaagtcattacagagctaatgagtgaaattgtattatttgctgtctctcattttcagtgttgattttgttggaaaacagtatcttaagaccaaaactctgggaactgttgagattctggccacaaagacagctagaccgtggggaagcaaacatctgtacacatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttttagtctcttggaggtttattcattgcttaggtactttttcaataactcttctcttgtttaaaatcaataaatatgattaatttgccatacatttatgataggtcaatatatttattatggaaacatatagctaacttgatttgaattaaattggtttatgcctacagatcaatattgttctactcctacaaaatcaccttgaaaaaaatactattggttaaataaagaagacaatgatgtatatttataagacaataggtatcaaccagagaaaactctttgcagttggcaatattgggaaagaaggccacagacagatttatgtcatctagatatcaaagagaatgaaatacatggctcagaaatttgttgtaaaagggaatggactcgtatttaaggacaggactctgaggactattcatggaatgcatgaagaagactgataaggatagcctataaggcacagtatagtagtatagtagaagtgcaccaactatttctccagacttgaacaaccaagtctaagagtaagataaggtaagacaaggtcaggaagtctcagggctggagaggtggtgatgttgctgaataattgctttttaaagctggaggggacttccaagagtctctcatttaagaagaaaaattaaagacataattggtaacggttttgactgctgcagaggcaacactttgctcacaatcctacagatctacttcacctgtaactacaattttcctgaagacatagaagaaaaatcaattgttctaatccatatggaaaaaaaaaaaaaagaaaactgccaatgtggtttgactagcaaaccactggagttgtggcttaagcataaaggattacttcttccattgccactaatctaattactttcccctatctgtctccattccagcaggcatgtttagtagccaagctgtattacaaaaaaggataggatgtgggtaggtaaagcaaacaaacggcaacatcaaatgcaaagtctttcatttcaaaggactaatgctctcttattccacttgtctccaaagaaaagcaatctcaaccaggtgtggcctgttatcccagcactttgggaggccgaggtgggtgggtcacctgaggtcagagttagagaccaggggtgggtcacacctgaggtccggagttcaagaccagggtggccaacatggtgaaaccccatctctactaaaagtatacacacacacacacacacacacacacacacacacacacacacacacacacacattagctgggcgtggtggcaggtgtctataatcccagctacttaggaggctgaggcaggagaattgcttgaacccgggaggcggagctgagatcacgccactgcacttaagcctgggtgacagattgagcgaggctctgttttaaaaaaaaaaaaaaaaaaaaagcaacctctccacttttctgagacagcaagcacagagatgttcaaattaggttgactatgccatacttcttaattatgtatctgcataattattaatagtgccctcttttactcacaaaagtgctctgatttggacaataagttatattgttatcctaaatacattgtgacaggaaggtcaacttatataagacactaaaacaaatttgacaaaattcattttagtagatcatccatttaacatatataattctacaagttcataacttatcaagactcactaagaaacaaagatttaagctatttttatatatttgttgtctttcaaaatgtttctttttggcaaataactttactttaaaaagtaaggcatagactaatttagaaaacaaaaaaatatcatttcctcacactttactctaaatcttattcagtgttatgtcattttttaaaaaaatttttgctttctcttaggacagcaaacatttttgagatggaagaaaacccatagattatttacttcaatgccttaatgttactatcaagaacactgaagttcagagaaatgaaatgactcacccaaagctgctggtctggtctaggtagcgaccaactaaccagaccagtagcctaatgagccaagttggttctggaactcctgactcctaaatacttgtttccttctgcattccattctgtctcctggattatattctctattttattaggttggtgcaaaagtaactgctggttttaatttaaaagtagtaacaaaaccagcaactacttttgcaccaacctaatagaagcctcctatcaggaagaacttcatcaaaacctagctttgccctaagcatcacattttcccactggaaaagggtagataaaaaagcaaaggaccaaaaataaaaatgataatttaccaacctctctctcaggaggcaaagtacagaggtctctgcaaaggagcattttaaaatgtcttaggttattgatatttgattgctttttgaagattatgcagagttctcctatctctcagtcttgtgattgtcttcagtatgaccaattgttatttttacttatttttttatgtaacttttcttttaggtttggggtacatatgcaggtttgttatataggtaaactgcatgtcatgggggtttggtgtacagattattttgtcacccaggtaatatgcatagtaccaaatagatattttttttctgatcctctccctaatatcaaagaagagcaacaactttgggaaggttggcccaggagacatcattgggaattgtaaaccaaacaagaaaaacataatcaagacatgtttcttaatattcaatttattacaacattttattggctctcaaagcaagtgttaggattagttttgctgaagaatttgacaattttgtttgtttcttttgttttgtttttgtttttctgagacaaggtctcgctctgtcacccaggctggagtgcagtggtgtgatcacagctcactgcaacctagacctctccggctcaagtgatcttcccacctcagcctccttagtagctgagaccacaggcttaagccacagggataaaatgaggatttaaacccaggctagtatggccccaaagcgtgggcctttagtctttatgttaccagcagaaatggcctttggatggcacagtgtccacaatgaacatctaccattcacttttattccatgttcatgtttaggaagcaatatgtttaaaatgaagatagctggagtcaggcacactgatagcttggatggatacacacacacacacacacacacacaaggtaaacgcacagagtcataaaacagtaagctggaaaactttagggtcaaagacccagatctacttcaaaatgtttcaagtgcttcatatataagaattgatcatagaattaataaccaaataatcaaaaccaggtcgatttaaaagaatatagtttacaatagctatagaagtcatgaaatattgagaaagatgttccttccctaaaataattcaaacctatagaggacacttaaattatccaaacaaataacaaccgcaagatagtttagctctagatattgtcagataaatatctggacttaatattctttacattattttatttgttttatgtttacttctacacttatatattcatatttactgtttattacattacattatattaatattattccattttactagaccatgtgtaggtcagataaattacttcctagaatatatcagcttatagcatcccagaaacaacccacaaagggttcttctttgcataatacaacagctcagaaagactcccatatctgatcttttgtcttttctcagtaatccgtctggcctacttcaacaacatgtcaggatattctgaggtactaggccacctgagcctaagacctcaaaagcactgagcctcagctcatcagattcctggctaagtactttcaatgtctgtagtagcctcatttgctcatgcttaataagctcataccatttagagaaaggactcaagtgtgagtaacacatgcttcccctagtaatgcacagcattaagaagcgaagtagaagacaaaactctctccctatttcacattcttctgagttcattattgccatgaaaaacgaatcagatttgagttgttcctaatctctgctcttctggtctccatcagagagggcagccaaactgtgacaggagccatctgggatggggacaggagaggagagagagccctgtagttttcttctggggaaaagcaggcacagggggtaggttgctcctagagtggacagcaacactgacagctcatcatcatttattctcagcctaaacaccagtggcaagagccccatcaggtggcactgagagaaggaggccaaagaaggcacagagaggctttaggggtgactaaacatacacactgttgtaggactgaacattcgtacatccatctcctctagtaaagcttgaggttttctatggcagaggctatgtcttaggtaccagtgttgtcacagcatcttgcaaggggcttggcatgggattgatgctcatagaatatttgctggaagcaggaatcaatgaatagggcccagcccttctggattccaccggctacttctggcttctcaaacacactcaggcacgtacacttgatttcaaggacaaagttgctgtctatttttaataaagaagcagcttgagtgaatcccatttctatttccttactctcatactgtcttctgtttgcgtgagcaagagtatggactaattccaggcttcagttcattttagtcacagcagaaatctaatcagggctgtatattctgtctctgtccctctgtctgtctcctttctctccccctccttctttctctgcctacctctccttcttactcaccctgcctccacctccttctctgcctccctccatctttgcccctgtctctttttctctctctgtcaggtgatatacaaatcccaggaacacagatatacacactgaactgaatagctcatttttcaaaactgtgtcaagattgtaatggttagtgtgcaagaaggaaacttatccttgtaacattaggatttttctttttctttaattgcgccctaagaattaaaccctatgcaaataggacttaattttgcgttcccactttttcctttaataattgtgtgtatatgtgtgtgtgtaagacaaatgttctttgttgaaagctaacagttgcaggcttcttttaaaggttataattatatttataaacacattgctatcaggtttacaccaaatagaccaataatttgccggcaaaaggtaaaaaatttaataaaaccaccttgttcgaaaacaaatttgttatagaaacacctgaacattggttttgtataaagtatatgcaagatgtaactggacattcatgtgattttaggtagaattttttgtttgttcttgtcctccagagaggattcagaaataagaatgacttggaattgggcatttaaaaaatatatctaaaaattctatgtgctgcggaggttggaattctaagttttttataagatgaactgccatgcaggtcacttattctaggaaagtctcctaataaataattcttactattaaccacctccagggtcacagaatatgttttaacctctttttagtgctgacacaaggtaatagcatcccctgatactaattctttgctgtcattaatttggattgtctggtaacacattaaaaaaaaaaaacagaccaagaaactgctatttcaagtacgaagaaaagctgcattcattattcagccatataaggaagttaaatgctacagcgccaaagcaggcaatgacagaaaactaggaataaagaagtttctttttaaaaactaggaacatagggaaataaatattgtgtgagagaaaaaagccaaaaccaacaataactaggtaggtcagctacacggagggactaaaacattaagcattcccttgcctctcaaactcagctattcatggccttctaggttaatggagagtggggcacggggtgcaatgtggttaatacacgttctagaatcccagaaaagataaatgactgctctagtttctcatcttctgagcagcttgagcatgtgttgaggttactgtcactgcaccacagcctgatacatattcctccttgtgtatgaaagccattcaaaggaagaaacagccctgaataagactctatgggaattacagtcaagcagtgctgctgaattctggatccaccctttattagctgtgtgacccagagaaagttaaatctctaagcttcaacttcttcatctgtaaaatgagtctaataagagtagctacttgatatagttgcaaagattaagtcatacggatactttaagaatagcatgaaacttgttgtttaataaatcttagtgccatcaccatcatcaccaccaccaccaccaacaccaaaaataatcaccactaccgccatcatctccaacactatcaccaccaacaccatcagcatcaccatcactaccacctccaacatatctagaaccaccaccattccaaccacaaccatcactaccaccattaccaatatatccaaaatcaccatcaccaacagcaccatgaccatcttcctcattttacaggtgagaaagttgactcagaacctcagtaactggctgaaaggcacaaagctggtaggggacagagagctcaaatttccaagtttagcgatcctcctaagcccatctttatctcaggaaatttgtcatggaaaaatggtgtggccttggtttcaagggtcaccacaaggcttcagaatacctaggaccccagatatctcatatgtaagcatagaaaagcaaaaataaaatcaaaaaactatatctggaaaatatcttagggtattttattaatatgtgaattgctaagtatactgcaacacctggttgccctgttatcatgagcaccagcctgaaaggtgagggactcaggttctgcttttcgttcttaccttcatatcttcaactgtcaccaaagaacacaatgcctattcccatatttagccctgtgaagacactataggaaagaaagaaactgtcatctacagcaccaagtcctcaggagaaaggcaggaaatgaaaaagaattgtttatttagcctggctctatagtgaaacagctgtataagtctgtgaaaagaaagggccctggcttggctcaacctttggcaaatacatgggtattatgtaggcagcatgtcgagccaggagaggaggcaatggaggagatttcctctaatgcttcccatattgttaattgctgctttccctcccagggccttctggacttcccaccagaaatccagggcaggaactgcaaggcactatgggaagacagcagcttgagtcctgcctgcccactcagcaccttccactgggaccctcagcgggctcacccaaggcagttacgaagattatctcatatgccacttacccacagtacattcagctatcttctcaccctttcctgccacctggcccagagccatttaactctactgttgcaaggctaaacttctgagtttcatggcatttatactgtaataagggactaatcgatgttctaccccaaacagtaaatctccaatggtcagatttcagccatggaggaaatatgatgaagatattttataggaaaacctcaatagttcccatgatattacaatgttgcctataggcaattttccacatctcagctttgttagctgacagagaagcaaaataacagcaaataaccccttgtatgtcttagaccctcaaggttgctctactcaaaagaattaagtatacttaaatctccttcccttggttaatggtgtcctaaggaaagaaagcaaagaaaacctcttcccatttcacaacttagtgtaaaatccattcagattttacaagatggtgacagagcaataactcttgagaaaatgatgtgacaatagctaattgtcaatggctaaggactcctcaaaagctgctcaatatccataggattaaagtaaagcagaaccattcctagagacccaaggactagttaacaaagagaaaaataaagtactaacaatattttactacaaatctgttaaattctctttaggaccttcaagaggcaaagtagtatggaagaacaagcacataaccttttatttcaaatagaaaagggttcaaatcctagatccataatttattagcactttgaaaaaaattaatctctctaagtttcagttttttcatctgcaaggtcacttacttcattgggctattataatatcacatgtatgaaaagcatttgagaacgggaaaacaatacgataataccattagtcttccaaattttgtttctacacattccacaaacaaaaagggttctacaaatagcaatcctttaaaggatgtattcaggttggtttaagtacccttataatgatttaaaatcccattatacaaaatgtacttttacttagcctttcattaattttgataatggtcctgtctattgaaactgcccatactcttagatttaccaaggtatgagtccatcttacaatgcacatcccattttccttttaaattatgcttttgtcctccaaaagcaaatgaaaatattttatctaaaatcaaggcttcctatagtttacaaaatgtctttaaaatgaaatttgtacttatcagaatatacaccatctcattatctcccattttagagtataaggagcatattttttctatttctgttataattcttagcccactgatggccacaaatctgtagcttattaagtatgtgcagattaactgatatataaattctcctctgcccctaacccagtaaagcaatcagccttctatgtaatggccttgaatgatgactaagaaaagagcccgtaatttaaacacttcaatgtggctgaactatgaaatctcaattgctaagacaaaattcctttacataatgatattataaccccaagctttaattagtgctggaaaaataagattataatagcaaatatggcaatctggttgacaccataaacaacctttctgcacacaatcaatttaagctcctggcagtactaaattcagactcataaatgttttttggctcttatcctatcttatttttataatagctatgcattcagaaaacatgcatttataaaaacatcttttagttataatttaggtttgcagatgatattatatgtgatttggctctaaaaagacataaatattctgttctgaaaagataatccactaaagcagaaatccattcaaatgctagttattccatacaaatttcttacattaatacattacctaggaaaattatatgtcagtataaaatatcatacctccatcgtatgctttaaaggtagcagataaaattctactgctataaagtaaagcttgaatatgttggagttattaaattgtgtgcagaaattagtatgtgctaacagcctttcttgtcttgtgatattttttctaatatttttcatcatttctgatttctccacacaattatccttctgttctgatcacttcaaattttcttaatatcttcatttcaccttgtttacatctggctgtcttattgtattttgttctactctcagaattgaattgccatctcacatagctaagtctatagagaattctatagaattctctagaacaagaaaagaacacaggtcccataaatagcaaaaacaaaatatttattttccctggaatataataataattccatagaacccatatactactgaaattttttttcctttctagtcttttttccaaaaagagtaaaatgtgatataaatattgagcatcagacagctatattggttaagatgtcttacacatactatttcctaaagttaatgaagttacaactacactgaaaaatataatagttgttaaaacaaaattaagtttgggtaggcccgttgtttaatatgttatactatgactaggaacctctggtaagctgatattctaaggagtatattaagtaaataatctaacttgcatactctgatttttcaactctgtactttaaatatataatactaaacgctcataatcttttaaattgtcttccaaaaataatactattgctgggctataactaattaaatttgatttgtatctacattagttaattagccttatcatttttccaaaacagttaagctaatgttagaccttgaaataccaaacaatattttgtaataattattaccattaaactagaaccattaaagaacaatcattaacagcacttcaaatgtgtagatattacctaccaaaccacaaatcaaattagcatattcttaatttattttttattagctgttaacattagacagaattccctgttgtaagtcaaaattagttggcattggtttagtatgtgtcattgattgagtttataaaaaagcatgtgctagctgttaattatatctatttaatgggattttgctttgtaattttaaaatgttttgctgagaatatattttattagaaattacaagcatcacttatcacttatcaaattgaaataaatcaactcatttatgtgagaatatgaataaatatttatagacatttttatattataaatttaaatgactatttctacactaaaaataagatcaaagattaggaatctatcttgtttttggaatccaacaatcattaaagctgtagtgcctcttattctccatccttgatcagattggaccttatttctacctttgttagggacttcttaaaattagcctttaaatttaggcttttccaggaatctctttatggtgctctggaaagaataataaagtctggctttgtgcacaacattaaacaaacatttttttttcaaagtacttaataaagcttggtggcgccatcagccatgtttaagtactgtaggttttgaaggaggacatctttcaagattaactatgtaatttgatgagatataaattcattcttaaagataagttgggtttaatctacatagtctgactccattgcacgatgacaaactctttcacttggatctgactgtatggaaataagacaactgccaaaggaaaaataatccataaaaaaataatgttttctaagctgctaagagggcagcacaactccatttgacccagcaatcccattactgggtatatacccaaagaaatataaatcattctgttataaagacacatgcatttgtatgttcattgcagcactattcccaatagcaaagacatggaatcaacatatctttgataatatgtttttctagaaaccttgtgtttgaatcttggtgcttaatttaaggttaagtcccagccaaacaaatctgtacaatcaacagacctatttagcatctacaaagcttgtcagtaatacaactctacgaagtcaagatgaaatctcttcaaaattaaaaatctagaaaaaagaaaaatgtagggctgtaatttcattccacttataagttaaatgctttgccatttctaaaatttcacatttcaattaagcaaatgaagtatagtaacaattttatagagcaagaaacttgcgattgatcttcaatactcctaagaacatatatatagagatggcatgaattattagccaattttcaccaactccaccaatgtttaccaattctcacaagaaatctaaatttctaaagatggaatgtggcaatattccttccaatttaattgcataggatgaatgttttaaatggaacttggcagaataagttattctatcaaatcaatgtcaatcctttttaaaaatccttttccttattcttctgcatcgtaccacccaaaagaaggttatttatggtttggtaaaagtcctgaactgcagaatagatagggaaagactgcttttcagataaaccagtatagagtccttattcttaagaaaaggtaagattaaattttcaaaagaaaatatgcttagtcaaacaaacaaaacaaaacacagatttaagttgttttaagggctacccttatgagttcatttaacgacatgaaatatacctttaacaacacgcagtacacttttagatggattacaagtgctatctactacagaagggttcaataattgaaatgattagaaaacataatcattagggaaaatataatcaatagggaaagaattcctagcaaaggaataaagttcatttgtgttaacctgggcacacatgaactttccaatgcaagaccactgaaaaaattctttcttggatatgaaggatattaatttgctactagatcactatctttcagtaaaataagtatcccaacaaaacacatctcaataagtgtaacactaacaacattagaattaacataaaatagatattaatcaaaacactttgctccctacaaacatcagaagatggatattataatccctgctttgcttgatttcattgtgatattgtactcgacactacttatcactatagtataacaacaaagagatgtaaagacactggaaggctctctcaggaaaatctgttctctctgcccatcccctccccctttttggtttgttttctctcactttcagtaggagaaatttcatatttaaagagcatgcattcaccatttggcatatcatatgccattatcgtaagagttaactattttcgaactgtatttatatatttatttttcttccctgaaatttctaaatgtccagtgcttcaaccaacataatcattcattttaacgtcgtttgttgtactgaagatattatagtcagcctccctccctctctccctccctcctttccccccagaaattgttcatagagtcaaattttctggtttgcttttggtgagttgagtgcaacacactttcctaggcaaagggggaacagccctctaaatatcaactctcagtcgaagaatcacttaacaactgggtacttcatattactacatgagcacagtgccactgtaaagtaccacgaggaagaataaatttttccttcttttctctgacctgctccctgacaactagacacgtggacagaaccttatttctctctccatcactgtatcagtggggtacagggtttgtttaataaggatgtaaaataaaaccggacttgaactacaaaagggctggatggcctttcccatgttggcataacactgaagaagcaggattggttatgaagtcataatttagcattggcatttaagcagaaacattaacttatattgtcacaaaacacaatgtcacataaaagccacaaaaatattttcagccagccctggtagccaagaaattattttcagggtgtttcctttttgggttttcccaatttgtactcagaaacgaagttagagacctattgtgatgttttaaatattccttttctgagtatataccatgtgattcaaaatagaagaccaatttctcagcctgtcttaagtcatctgataaactgtgtcccatcactcattttatcatagtcacaatgtagttaaaatgtgtaaatgtataaaagtaaaaataaaattctgatgtaaataaatttaagatctctgtgtgcagagcatattgataactggcacccaagcaaagactgatatcttgaaagggatcttgtataaaagctattccattccttgcatgctatttaatttaaaaaatgatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatatggaacgataacatttcctcgagctccagatgttctcaatactttcacctccatgatgccaatgctctcactcacatgagtcacaggttcctcaaaagtaaaaatgcctgcgtggtcatcatcaaaaatagttacagtggcagtggagggagatccgaggcaagcaagtgtagaaacatgattggcttccagtatgccatcttctgaagcttcagaagatactttgacattgctgagatgcacaaggaaattttcatcctcctcaaagatatcatcatctatgatacccactctgatttccttctgggtatcaccaggcttaaacaccacagttccttcagtaaattcataatcagacccagcatttgctgtgccatcctctgttctgaagtcaacaaacacagtgttagtcaaatcaccacctctgcggataatggtaagggccacagtaccacagttctccagacactgatatgtcccttgttcaaagaagatcttactaacagggtcattttcagtcacttcagtgttgacctcgtgcatgctgacagccttccttgcttggtcagctgcatgcctctttaaaatgttgccagctccagtcatgaggcgagtagcttgaatgcgataaaatgctctacttttttgctgctgacttaggacttggtagttagctaattctattaattgctctatttctttatctggatgcttctgcttaagttccttcagaatcctagccatttctcgcctagcttcttcatcatcttggtccctctcatccacctccagaaccagagcaccatctaagaaattttcaacatgagaattgaccactttcccgtccatttcaatttcagtcttagaagatggcctgtctccttcatgttcaataatcatccccctctgcttgccagctcgatacctcttgtagacatacttgtaaaacagaagtctcctatccgctacccaagcgaacacaacacagatgggaaagaagaagaaagtaagcaaaccttcccagacctccacaacaccaggagatatgacagacaaaataatgtaaagccaggtgtaggcaaagatgctccaggctgctgtcacaaagaagacacgcaaatgcttaatcttccttgtctctccgtcaggcaccacataaacacagagtgcaataatgatgaacatattgaatgcagcacttcccacgatggtgctaggaccgaggtctcctgcagtgaagttatggccacacacttcaattactgaaaggagaatctcaggagcagaagatcccagggccatcaaggtcaggttagaaactgtttcattccagatcctcacagttgtcttggtggtctctccattgggtttctttatggttatttctttttcttgagatgtgatgacttctatagaggacatgaaccgatcagctatgatagagactccaagaaacatgtagaccatggccacaaaatacacagtagctctagcaattttgtccccaaaagaagggtcttggggttcccaaatgggcaaaatcacccctttcttacagtaatatgatccagtacattcaccagtttcatttccttctccttccatttctgtctcagcaattacatggtccacatgggaaaataagagactcacagtaactaacagatgaaatcccattgaaaaggtgggtgaaagacttaatcgccgcatgttgtacatgacacttccaactgtcacaacctactggtaaaaataagatgggggagagggcagaaaaaaagtcatgtcattagagctgcagccaaagcattactaattacttatttttattactcttaccaaaatttgtttatatttgaccatcacaaaaccgaaatttgtttatatttgaccatcacaaaatctatggtgaatgattgttctaagactccatcagtgactaagcaatcctttgtaaagtttacaactcaatctttctgtgaatttactacatgtagtacccattcactgagcaagatacacaattgacttactggaaaggaaaagttcaatttatatagccttgccttattaaacacacatttatgcatgctaatagccaaaatcacaggacttttgaagcattaaacaatttcctcctttttactaaagcagattttcttctaaatttgtgttagtacatcatcttccaaaaacggtttcaatgccaaaagcaccttattacaattgatgctttgaaaatcagactccgaaaaaatcccaccaacacaaggcctggtgattatcttaaacgccagagagcatcttacactgtatttcatgaaatcatgtcctattgctccacacttacttggaaacaaaacttcaagcttgcctgaaatcaaagctcaatggcatttgttcttgaggagaaaaaaattctgctataatgcaatatttccacacattaagtacagtttttaaaagcatgttttgatgagagcacatttctttctaattttcagccagcccaggtctgctgatacattagcagctgggcatctggttcttcaagcacagctcttcacatctgtgtacagagcctgtttttctgcaggctggaaagggagataaacaggccaaggcctagttgtgggtaagcgcctggcaggctgtggaatcagcgtcaccaaccttaaaatgttccttctcggtgtcggtcatattttccatggtcattctaaaatacatattagttctgtcgagggttcaagtgaccaaaaaatgcaggaccaataattccatttaaattagctcatgtggcatgacaagagtgaccacaaaatatacacatgatgaaggactgtaggcaaggagggccatggcaacagagtcagtgagcagcacacaaagcttggtaggcatagcagtggactcaaccaccatggccttaagtccacccaccagctcaagcaaaactctactcagaccttacatcccttctgcttccagaacctgggatggaggtgaggggaaactgaagtagaggaaggtctgctccaagtcaaggtgactgtctcccaggccttgcaggatggactagttatgacatcagataaagcagcaataggaagaagccctgagtcagaacatacccttatgtcctggaaaaagttaaaagaggaactggattacaggctttcatagcttcgggctggctgagagccaccccacattcgcctacactctctggctcatgtttgctgctgatggcttatactgcaaactgcaccagtgcccaggagaacaccgctgcctaggacattctggcagaccctgagagatcccaccatagactaaagccctttatagctcatcactacagggagataagcttctttgacatttttcccatactaaagaaaatcagaggagggttatagcagtagaattcaaaactaagtaaaaggctgaaaaatagaggtagcatattttcaaaatatgcaaaagttctggtcagtatgtctgcttgttcagtctttgaaaggctttgagatttctgcttgaaacaaggtgaaatttaaccatcctgcaagaatgttggaagatctagttccaactcccttgtgtatccatttcatccacaatatttatgcatgcttaatatgtattttagaaagacttactagtctgtcttctagatcctgagaattcaccagtgataaaacaaagtctctgtcctcacagagcttatattctaatggtggaggaaacaaacaaatataaatatcagaaggttaaaaactcctatggtacatgtgtgtgcagaacaatctatagaggacaaggagagtgtgagattgtgtgtgtgtgtgtgtgtgtgtatgtgtcagtgtgtatacacgtgggatgcatgatttcatactagatggttaaggaaggcctctctgataaggtaacacttgagcaaagtcctgaaggacacgaaagatcaagttttgtggatatctgtaggaaaagaattccagcaagtgcaaaggtcctaatgggaatcatgcttggcacagtctaaaaacacagaaaaccaatgtagcaagagggtaatggaccaagggggcagggctcaggagtgggaatggatcagagaacactgaattgccataaggcatgggctttgatggggtagaagatgagaatcactgggaggttctaatcagagggtgatatgatctgatttttcttttagaaggatctctctgctggttcagtgcagaaaagactgaaggggcaagggtggaaacaaggagaccagattttgcctactatataaaatctaatttataagtgatcccaatacttggcaggtatacaaaatggtacagaagatatttaacatttaaaatggtgaaagaaatgtcttggggacctgaaagaatcagaaaggtgaaatatttgtgataaatagtagtactgaacataaacactgaagggagattcaaacctgtgtctgtctccaagactgatataactaaccactcccttcaaattactgccaaatcgcatcattccattcttcacgtttcagccaaaatgaaattcctaaagtgcagatctgacactcttcacgtcccttaaaactcttcattggtttcccacttccctgaggacaaagctcaaacccctcaacaggctttctaagaccttttatgatctggcatctgagctccagaatatggaaattattcccattccctgaacaaggtaacaatttcttacatccaagtctttgcagattattctgtgtccaaaactattttgctttttccttcttagaagcaagtttcaaaagagctgaacaccaaattataaccaatttcctgagagaatactagattccattcttaaacagtcacagataccatgctaaattgtctctatacatatcaattatatttaatatttccattagccagcattgctgttataaaatgcctagtgttgctatttccattatagtccatgagaacagcacccctggagatgtgcaatgcacagtaccctaacaataatcctaaatagtaggtactattagcccatttggaggttggataactgaggcttagataggttaagtacttgctgaaagtcatacagacagtaaactcctcaactaagacccaacccctggtctttttccaagactgatataactaactgctccattatatcatccctgatagtgtgtgaagtaatctttgagaactattggggttggcttggactagcccgttggaaagcctcttggcttccatgcagggtcaggagggcctagttagcaaaagtcttgtggaaggtttccaatagcctggcttttatcttatgcattagactcaaacagacaagcatcaataactgtgatgtaacatgagggctagcatgttcctagagacagctgcccttcaatctggtcttttagcaattgcctggcaacctcttcctgcatgcactgtcagggcaatctcctgggccagccaagaaaaagccctgccctttatcccttccctagcccacatcccacaatatgttcttagccaaaaggtcaccagatgtctaaaggtagacaggtcagtaaaaatccatcatcattatcagagaaaaaggaagggggcttccggtgttaactaaaaacattacaattatattcaaaagagagcagtattataatttgtgaacagtggacacagcacactgatgtagcttattggcaatgaagcaattggaaagaactctctggacttaaatttctttttcttattaaattaataccaaattcaaatgcccacgaagatgtggaatagatgttatctaaatgtgagttccttcttcatccttttgttttctttctttcggggtctttcctctatcatcagattcaaagtagttctactaaactctccccattttccctcaaatatacatttccatacaaattaagcagaaagataagaatagagactgtggatatgttgatttgctgcctggctttcttatattctgccttaatttaccaatacaaagtataggctgatttttatggtggattcagatcaactcgtacaactgtgagcagtactaacttaaaatatccattacatcatgaaatgagactttagcacagtatcaagaatacccaaattatcttctgatcactatttattttaaaacaacacacaacccatcacccacagattacagacccaaatgacactgacaaaggatggtaaaaagatatccagctgtgagtagtccagccagttgtgtcggaggaagaggtcacagctacaaggaatagaaacccacatctacaagagatagatccaactgctttgtaaaggaagagggagagcttttggagcagaggcctgaagagtggttggcagcacggtgaccattccctgctggaagctatagccagttttgactaccaaggaggacgtgactcagagcaaaggcatatgctggcattcctaacagcccaatatattggacagtcatcctaatggcatcctcttgattggcagctggggttattccaaggaactccttgatggccttcatcagtacttggaattcccttctatgtaattcttgctgactgaaagactcaaagctaagcaattaatctgtttctaaggcaacattaaagcaaccataaatccttatccactaccaaggcaagcacttccaaatgtttctagacaaagagatgatgccagaggatgaaggcttttctcatctgaccatctcacctaaagtgaaaattactgccctggctccagcctcaggctatcagaccatggccagatttcaggaaaaaaaaaacctcatttacacagagaccctctactaatacctaattttcccttccaaagaaagtttcctctctgctgtttaatactttgggacaggtgccgaaggggatgggctatgagcggtcacatcataggctcaagcctttctcttaaactcacaaaacagaagtcaggcccctgccttatgaccaaaaatacccgctgaaattgtccaggaaatgaagaaactagggtgaaggtaggcaatgtggtcacaaaaggaaagatagacttaggatataaaataacgaagttgttgaaaactcatgagatgcactgttggccctttcccctactttatttttcgagatagcacttattacttttttgtttttgtttttgagacatagtcttgctcctgtcgcccaggctggagtgcagtggtatgaactcggctcactgcagcctgtgccttctggattcaagcaattcttctgcctcagcctgccaagtagctgggattataggtgcctgccaaccatgctcggctatttttttttttttttttgtatttttagtagagacagggtttcaccatgttgaactcctgaccttaggtaatctgcctgcctcagccctaagtgctgggattacaggcatgaaccaccacgtctggccagctcttattacttcttacatgctatctattttattcaatggttctatttattgtctttctctcttcaaaagatgcaactctctaagggcagggattttcatttcttttttttcattgaggtattcccagttcctagagcacagcctggcacttagaagatgcacaacatctgcttattgaatgagtaaagtaatgctcacagggtcacgtgctgattcaccaaatctccagtggtaaaccagaatctgggaaatgggcctaagcatttgcagttaaaaaatgttgtctgtgtgaaatggttgcaccctaacatgagcagagttcaaaatcagattgtaaagtcaatgtcagtgttaggaagagaggaaacacatgattcagactcatgagcaaagactcttgggctggaaagactgatctccagcataacgagagcacctgggccctgacattttccccacaacctgggtgtgtgtcttccagcatcagccctggcttgcttattttatatgctctgttaagagggccctaacactttggacatactcaaggaagtacatcttcccatccttccaatacaattaaaagacacatattcaagcacaacaaaaatcaccttcattgtagaggccctacacaagggaaagaacaccaagcatttaaatttaaatattaatctgcatgctaacacggaaatatgggtagaaaaaagaaagctggagaagagagagtctttcaatagaaaataaataaaaaagaatgtagaaggaagatgctctgataatcttgggctccatgtgaagttagccaggtttgtcctctaattcattatgccagaaccacagagcagggtttaagggccctactcagggcactgatggcaataatgactgaaatcatggactgagcatctacttgtcccaggtactgtgctaattactttgtattcactgtccctgacttttctgacgatactacaaggagatattatcattcgcattttacaaatgagaaaaataaatggttcatgaaagtaagctggctagagtcatatatacttaagtgacagaactagaattttaattcaggcattttgcattaaactataacgatttccaaaatggcagacacattttattttcacgacaataagttaacaatgttttctggggacagagagctcaagatttaggtacttaacctgccatgctgccccttcttcccacctgaataaatgtgtgtaggttgcattagctcatcaaggagcctcacatgtttccactcctgcctgatgccttcccactccccaagtaagtattgtaagcacttctattcgtcacatagcaagggaaagatgatccatgtgaaggatcatcagctgaagacagaggtctgaaatcactccaaactcatgtagtaaactcaaggtttttccatttggtcaggagaaaagcaaatgaagaaagaatccctagcagtaagcaagcaaaactaaaataaaagaggggaacggataatgaacgggagccagggagaatgatacagaatgttgctataacaagtaggttaacactttgctctaataacaataattcagtattttttaaaatagaatttcattgcagctcaaaaatttactgtcttgggggtcatttttcttaacatcttaaatttaagccaataagtaatccaaagaaatgcaaaaacaacacattcgtttatggttttatctgccaagcttttcttagccactcatatatgccagacactgtgtttcaaagataaataaaacatatctccaaaggagcttgtattctagtggggcactggcagaatcaaggagtgagtcccttctgtggaaaccaggacccttccattactagagattcactgaagagaagagactttcctggcatttgaacattgacactgagcactgaagtggactacctagtccccaggttaacgtaccttgagtcttgagttaataaacccagcattctagaaatctcggactgctcagactgtggtcctgcaagctagagatttcaattataatgagctcccagaggcagagccttggactctgtacatctttcaaaagcctcctgatagacaatggtaattctttcacataataattgttcaccactaaccctgaagagaaacagcagcctttctttgatgtttgaccttaaacactgaaaaagaatgaggtcatatacatgcttttatatctaggtcaccaaaaaggattttctacctaaaaatatttccccaatagctggttgacatttaatcttaaaaatctgtatatatagtgagcccttcctatgtttctagttctagaggcaatgaacccttcatttattcatcaagcctctatggagtagcttctatgtgcaaagcaccataacagacactacagggattgcaaatatgattgacacgtggtccctgtacttactaaatttacagtctgcaagcgacagttactccaatgaccattaatactaggaagaattgacaaaatgtcataaaaggaagggatgggaaggatgacaacggctagagaatgtgacagcacattctaaaaggaagaaatgatatggacaaaggcatagagcaatgattctccaacttcagttcacctaagaatcacctggcaaactaattaaaatgcagttaacagggccctataatcagatacagttgaggaatctccaaatttgaattttaacaacaatcccaggtgattgtcatgtaggtggtcttggaccaccctttgtgaagtgtaaggcagaaagagcagaactgagtagaagcacaggaacagcacacagggcatggggcttgtttagcaaacagactggaagtgcgtgtctgaaaatcagaaaacagtgtttgttctaatatcagtaagatgttgatgttaagtaatatgtcagctgtgctttccctctcacagactgggtctccaggcaggatcaaaatatgaagccccgtagtgaatatgtgtccaggaggtgggggactagagggcagaggaggacagatcttaataggagaaaagaggggccccaaaagggagattaaagcactggaggtaatataaagttcctacttcatgatgttgctgcaggtgttttgtcttctctaagaagaaacaagcaaggattactaggtcactacattggcaggtgacaaagacttaggataaagggacatcttcagagacctattcagtttctatatccaaaccctaagtagaggtagaaaacatgcagaaacatgaaccccaaaatgaagtactgggtggtaaggaaagctgtgctcttcaaatgacaagttctttagggggcagcccctactctttttcttcatttcaactcaagaacgaatccctgtggtcactctttcttctttctagtctgcctcttggaactggggatgtttaatacagaaaccaatctcaagttgaatgacagtcaatccagcaagatttttttcttttttattttttaatcttttttaacaaggtaaatgctggttgtgtgagcagaggctggtgaatttcatcagctttttcagtgagtcattaagattcatcttcaagtagatagcatttcagaagacagaatcctatcaacttgaggtttttaagtcttagattttcctgcatagtttcaaattacagtccttgaaagaataagctcttcttgaaaagagtggaagtaggaagtaaaaagaaacatattttaaaaagtcaaggtgatgggtgctcacataagggtgactctccatcagtgttgtatgctacaattttctaaagttcctgacaatatactcagtgacaaagttctaacaccaagtgtctatttacatattacaatattgtatagtatatattacctattacaatacactttaaaaatgaaactcaccttagaaagaaactagtcaaatcttattatttagaggaccaaagggagtgttggtgacatgggaaaacacaacattcttacagaaatctagtagagaaatacatggtttttctctactagctagggcatctagtgaatatgttctttaaaccaatcttatatacctgtgtttgaaaaattattaaaattggcttaagtggtatggttttaacgttagtaactatgctgacactgctagattattgtcttttggtgacagatgaggattataatagatgtgaatttatcta

SEQ ID NO: 356 - DNA, 141816 bp, Homo sapiens
cgacatccactcttgccagtgacttgtcagccactgcaaaccccaaaaggtcatattctcttccccagcactcacagcataaactaacccttggtagtgagcccagggtcatgtgttctcacagcacacactagccctgggtttgaaagccaaaaagatcaggaggtagagggtgtgggggcggcagctcagtgcacagttagctctgggaggagaggaatttacaaccctcagggctccatgaggaagacaggagacctcaaaaggggtcagcagcgcctctcctcattcctcagagggtctcaggagttgtcagcagtgtgctttgggtcctttgtggtcaccagatactgtcaaaagacgcaattacaacaaatttagtttcaagatcctaactggcttttctttgcaattctagaatcaggcaacacttcatggtacactatagaatatgctatacagcagaggactttggctttccagacagaaaaggggtgaggaaagcagtatcagagaacaaaacgcgcactggtcctttcaaagttactttccttgtaaagattcaagcagaaggaacttccttactgtgccagctaaaactggcctgtttgggaaattgctattatctctctctctctctcctgattttttagaaggtcagataaacaatgtagttttggcttggtggcatgaaacttcagcatgagtcgttccattttggtttggtctctcaggcctagtgcaggagctcagtccaaaccaatggcttccagtaaatgttatttaacagttccaagttcttggagaagggaagggaggaaatttttcagaatagtgtggctataaccactgggcgaatgaatgccttcaactacataagagccttttaactggtcttcctctagagtgagcctgccccaaagcatcctatatgccactgccaaatcttccaaaaacattactaagataatttttaatggtttcccatggcctcccaatgtcataatctgtcctctagccatccttctagacttattcccacatgacaacttctgtgccagtaaacatggtctagccgatgtcagggaaatgcagcctgaactgcttccttgttgtgtcttgattcatgccatccttcctccttgaaaactggaaaatgtacctgtctttcaagaaagctcagattacacttcttttgaaatttcctgattattccaattgcaagcaacaactatctgtgaaaaaaacaattgtcagggccagtgtcatgggcctatacagttcacagggcctcaagaataaaaggccccatacttagtttacttctcttctgctgtcttgaaattctcaataatttttcagtgaggggccctgcattttcattatgctgtggccccacaaattatgcagccagtcctgataactgtcccctgaggaaagaacttgtatccctatcttaagtgatttgggctgctcagatcacggatatccaattcctcacagagtcagtaaccatggtacaaaaatattcacttcctctccatttctgtctagtcaatctattgaatatcaggccagttttatgcaagagatcagtaggtccttaatcccccctttctccccagtacaattatattttcaaaagaatatgctaacttagtctgtaattgccaagtttcagtgaaggcttggaggctgggtctgattgcaaggctggccctggggttggtgtgctggagtttgaggcaggagcagtgcggtttgactgatttccctaaattgttttgcttttctctgctttttctccttctttatttccgtaaccacaggttctctaaaacacaggtgtttctcttttctcccagtggttctcgtcaccacaatagaagagttttgttttcaggaaggagcagaggacactaagtaagagtgaagagccagccagggctgtctgtgggttttttttttttagacagcgtatcactctgttgcccagactggagtgcagtggcctgatcttggctcactgcagcctcggattcctgggctcaagcaatcctcccacctcccacctcagcctcccaagtggctgggactccaggcacatgccaccacgcctagctaatttttattttttgtagagacagggtcttactgtgttgctcaggctggtcttgaactcctggactcaaacaatactcccaactcccaaagtgtcgggataatgggcatgagctaccacacctggcccagggctctcttagggtgttaagaggaaggttttctttttctcatgagattttaagttctaggagcacaaaatgcgtttttcatgactgagcttatctcctatagcactttgcacattgtaggctctcaatagatagcttaggcgtgaaataagaagcagctaatacacatatacaccatggaacacgatgcagccataaaaacggatgagttcatgtcctttgcagggacatggatgaagctggaaaccatcattctcagcaaactagcacaggaacagaaaaccaaacacctcatgttctcactcataagtgggaggtgaacaatgagaacccatggacacagggaggggaccatcacacaccagggcctgtcggggggtggggggctaggggagggagaaatacctaatgtaggtgacgggttgatggatgcggcgaaccaccatggcacgtgtatacctatgtaacaaacctgcacattctgcacatgtatcccagaacttaaagtataataataaaaaaaaaagcagcagctaatagaccacaccagccatgagaggaacccctgcctcctaaactcctcgagtgccaagcaccaggccagggctcttgtgtgtatccctccagtcaatgaacacacaattgccccctgaaaaccgcccctttgctatgcaaatattgacacgggaggtaacgggtagatcataactatttataagaaccatctgtgtttctaaacagtcatttacttaatattttttaaattaagctagaatttctaaagagtataacaataaacttgttacctgttttgaaactaatgcggagtttgtatttactggaattgtgagctttatgcacttgtttactaaaaaggatattttgcattttgacattttcttacttcatcaaaagctttaatgattttaaaaagcagaaaagttactgatgtgcctggaaaaatcctgagaaactagagttaggaacattctctagacatggaaaagaagagatgaaatacaccaagggactgaaatgaaatacagtggggtaaaagatagaggatattgaggaacgaaatgaatgactggaaagaaaaagaagaaaggaatgccacaggagtgagcaaatacaggtactgggtgtgatcaatactctgtagtcattggaaaacagcatcttgggaaatttgttacagaactgagaactgcaagaagatattggccaccaccaccatgaagcccagcacatcgttataataactattaagatctgttagaacttcctgctactccagttaatcacggactcttcagaacaaacccagggcaacactgctatgctattgactgaatgtttgtgtcctccttaaattcagatgttgaaatcctaacccctaatgtaatggtatttggaagtgaggactttgggaggtgatcaggtcatgaggacagagctctcatgattggagttatgccttataaaagagatcccaccgcgcttgttcacccttccaccatgtgaggacatagcgagaagatggctgtccatgaaccagggggcactcaccagacactgaatctgctggtgccttgatgttggacttttcagcctccagaactgtgagaaataaacatttgtcgttaataagccacccagtctatggtattctgttatagcagcctgaacagacaagacagacattggtactgaggatcaagatgaaagtacctgctcaagttcacacaggtgacaagcagcagaagtgagtttcaagccaaggatgcctgatgccacgaccaaggccatctcttcagcactcagcactcagcagtgggtgggctttctgatgaaagccctggggaaggagaacaggactcacaagggatggaggctgtaatttgcagtgtctggctctaaatcatggcggtcacagcaaatgtcctgtacttgtatttagcaagcactgtcattagagttgccttccataaagcaaggatatgagagtgtgtcagtgtgtgctggcatgttatgtggggcttttagctttaaaagtagcacttgagccaggcgtggtggctcacgcctgtaattccagcatgttgggaggtcgagaccagtggatcacgaggtcaggagtttgagaccagcctcgccaaagagaccagcctggccaatatggtgaaaccccatctgtactaaaaatacaaaaattagctgggcatggtggcaggcactgtaattccagctacttgggaggctgaggtcggagaattgcttgaacccgggaggcagaggttgcagtgagtcaagatcgtgccactgcactccagcctgggcaacagagggagactctgactctaaataaataaataaataaataaatagcacttgagccctggaggtcaaggttgcagtgagctgtgattgcatcactggtttgtagcctgggcaacaaagtgagaccctgtctcaaaaaaaaaaaaaaaaaaaaaaagaactctctatagtttgtgtattagtcagggttctctagaggggacagaactaataggatatatacacaaacacacacacacacacacacacatatatatatatacatatatatatgagttttttaagtattaacacacatgatcacaaggtcgcacaataggccacctgcaagctgaggagctaggagagccagtctgagtcccaaaactgaagaacttgaagtctgatgttcaaaggcaggaagcatccaacacaggagaaagatgtaggctgggaggctaggccagtctattcttttcacgtttttctgcctgctttatattctagctgtgctggcagctgattagatggtgtccacccagattaagggtgggtctgccttccccaacccagtgactcaaatattaatctccttcgtcaacaggctcacagacacacccagaatcaatactttgcatctttcgatccaatcaagttgacactcagttttaaccatcacagtttgtaacttgagcaatgacacatgaactagcaaaatgtcctatatccactgttacttctttgtgcccaatcactgaatgccagtacgtctccaaggactcacgccagcctgtccttaacaggtcaaagaattaaaacaatatcctagggcaaagtttcatgagacaccagggatcctacaggctgggacttcatttgggaagccaactggtgagccaatcttctcttgctgccctcacctcacagctcagtccttctgggagtcggaactacccaaactcagcaaacagtctagtatagaaccttgagcaaacggttcctgttccagcctaacaccgcctgctgctgccacctctgccatccatgcagcctccctagcctccagtctctctctgcccatgccaactgtcccttcctggactgctcaggtcctagcagtcagatttctgctcaatttctagttctggacactatgtcccgttactgtttacggctctgtgtctcccagacgatggagaaagaaatgtgacttagtcaaaatggaacaaaaatgaaaaccaaccaatcagctaaccaactaaaacaaacataattttaaaaccatacacttttcatacatacattcagctagtctaatgccaaggggaaaccttataggaaaaaacctctcctgcttctctttattcctataaagattcttcagagcacttataaaagcacctggcacattagacatttatttgtagtttattgacttcccccaccctctacagattgttaagttctaagagagcagggacttttgtctccctcacctgtaacagcatccagtccaaggtgaggacgtcatacgtttattaggattggaatggcaccagctgcactcctttccacgtttattttcaaggtcaccccaaggttttctttaacctcattaaattcatgccctaaagtgagaggaggtatccccttgtgccagacccaggctgactctgtattgttacacattattctcatcctccgatccttacattaggtgaccatcacacattttcactccgttccacattagttcccatagttgcactttcccatgctagtttcccattagttgaccaagcatttagttgggctctgagctcttaaaaaccaaaggagaatctaattttgaataaaaacacctggccatactgaacaaacgcagggaagaggtggtggtcattattttcctgtccccccagctgtgtggctggacgaagcttcctgtgaatcctaatcactttacctcctgtggcatgattcaaaaaaaaaaaaaaaaaaagcagctagagtacaaagcctaaacagagtggctctgttgctctgcctccaggtctttttcttttgaaagtgcaatctagtaataaccaaacgcagtctgcaaatgcaaatccaattgcttaactaattgtgttctcacccctggagtaatggaagttcatgctgtagaagaaaatctgaacttagcatggcccagggttctgggttctgggttctaaaggcaggcctgcgtagagaatcaactctaaggaagctcgctcaaaggacggaggtggacagaagagagatatgcatggttgatcaagtgggagcagaagacaaacgccaccaccgggtgcagtggctcacgactgtaatcccagcactttgggaggctgaggcagacggatcacttaggataaggagtttgagaccagcctggccaacgtggcaaaaccctgtctctactaaaaataaaaaataaaaaataaaaaaaaacttagccaggcatggtggcaggtgcccgtaatcccagctactgcggaggctgaggcaggagaatcacttgaacctgggaggcggaggctgcagtgagccgagattgggccactgcactccagcctgggtgacagaacaagacccagtctctctctctatatacaaatatattctatgaaagtgggtctcctctataacattcatgaagtaatgttgattttgactgacgtatataaaaataaaactcctaagtttagcagtatttactggagatatactacccaattcattactaaaaatgtgaaaaagattttagttatgttcaagatcccttcggtgtggcttattgtgaaagtgcacatgtttatctctttttttttttttttttttttgagtcggagtcttgcccaggctggagtgcagtggctcgatctcggcccactgcaacctccgccttccgggttcaagtgattctcctgcctcagcctcctgagtagctgggactacaggcgcgtgccaccatgcccagctaatttttgtatttttagtagagacggggtttcaccatgttggccaggatggtttcgatctcttcacctcgtgacccgcccgccgcagcctcccaaagtgctgggattacaggcgtgagccacagcgcccggccatgtttatctctgtttatgtactttttcatttgtttttcacagtcttgctctttttaaaacaacaacaacaacaaaaaacttctagaaatgaggtctcactatgttgcccaggctggtgttgaacacctgggcttaagcaatccttccaccttagccctccaccattacttctaaaaaataaaaccagggttatgaaattgttctggtgggaaaagcttgaagtctctagtcttcttgctttcatggtgctgggtgcccaggatgactatttgcataggatttgccagatgagcatgtggaaaggcctgtcttcacaggtgtgcccctaactttgcaccttcctatcaagggatgcattgttgaacggctgcagagagagctgtacccagccttcacatttaaaagaatatggaaaactcattacttatgacattgcctgagttcaaatcctggcttttccacatactagtgtgtgctcttagccaagttatttcttccattgtttattaaaatataactgctgtttttaaatgaagtcatatatacacatggtcaaaaactctgacaacaggatctggcgaatctttctcagaaattttctaggaatgtgtcacatatttcctttttttttttttttttacataaatgtaccatacataatgttctttttatctttcttaacacctcttagaatattatcattttcttacgggcttcctagtatttttgtttgaatggatgtatcttatttactgaaacagtcctgttaacaaacacataggttgctttctggttggagttattacagaacaatctttgatgaacatctttgaacacttgtacaagtgtttgacaggataaattcccaggagggctgctgggtccaaggctacggtcattttcgatttgaataagtattaccaaatgggcaagttatttaagtgatccctgagtcgctcttctttgtaaacagtggacaataatgagtttctcaaatgtttcttataaggattaaatgagatggggatgtggaagcctagtatacagcaagcaggccgtcaatgaatgttggcctcccaatatttttttttacggagaaagacaactatttatgcatattatgatgactatagcttaaccatgagctcaacaaacacaaaaattcacagaaaattctgcaataccgtatctattttaaaccccattattgaatataactagtgaaatctcaggtcaaatagaatgtatttaagaagacacaaacttgacattaaacaccagagatttacatttgatagttgtctcttcttacaaatatatccctcataataataaaaaagcactccactagtatgccaattaagacacatcttccagtcgtgttttgtccttgagtgaaaaatcttgctgctcaattcaagtcattcgtttattcataacacccatatatatatctccaactctggaaagaaacactgacagaaagatggaaaattttagagacctcgtttccacttcagagagcctgttgtcccccaaacctctcgggccctccggtatttttaagcttatcaagattccagaatgaggttaacggggcgtcacagaacgaaaccccccaccgtcccgtcccaggggcttcaagccaggaccccggcctgagggagcctccgggcaggaggaagaggcccaggaagccatcgctccgctccttcccagctgtttatgtggtactcagggtactcggccaagggcacggcgaccccgcaacaccccaggcgtggggcaaagacagcggggttgcggggctcctgtctgcccggggcgtcgagagttcctgccgccccctcccgcctcatgcacggaaagcgccgagccacggcgtgcggcgccggccgagcgtgaaccggagtcggggttcggctaccccgagcggctctgtgggccgcggatcgcttcccctggggcggccacgcagggttgcgggccatggcctggggcgcccgtccggaccccgccgctgcgcgggacgccgctcccagcctcgaccaagggcgcccgggggcggcggcggcggcggcggcggtgactgcccggggcggcggcgcggcgcgggggcggccaggaggcgaggaggccgggccgcggccgagggcccagggcgcgcttccggcgggcgtcgcgcgcgccgcggtaaatgggaggctcggccgacaggggcgggggccgcgcagccggggactttcaggaactgcaggagcgtgcggcgcgggagtagccgagcgcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggtgaggggcgcgcggcgcaggccgggccggtcgctcaggcccggggcggcgcggagagggtcggggccggggccgcggggagggtcggggccaggggtggtcgaggggccactccgcttcctcggtggagtccccgggcgggtccgcggcccagccagtcccttctgggcatgggtgcggcgggcagtgcagacagaccaccaggatcgcaccgggggacggcgtcgggtctgggcgcgggttgggaccccgggcgcagcgaggtttgggaagtttgcacctgagcgtgggctgcggcgggctcgccgggaggggccgcgggacggaaacttcccgcagcccggggaggcccccgaggcgactggcgctctgtggcgtccggcgtccccgccgcccccacgtcccctcccgctgccgcctgggggaccctcgcccccgcggggcgggtgggggtcgagacctcggcggagaggacgcggcgcttcccgtcccggcctgcgggggctcgcggccggggagggaccgaggctgggacgccccgcgcccctttgccttcgctgctgttatttttttcttttgttttgctaccttttcattgtgaatggcattgccggcatgaataaaatatcaagagggaaatgactgtgctttcgattacgtgtttgcctgaaaaaaggcccaggcccgaattacgtggtggaactttgactcctgcttcgtcattggctaggagcggtggtttgcttgttttacgttattgtttatgaaattagcagtcactcttggctacctgaattttcaaaagccaccctcccccgctccttttccttgggcgttttcagtagttacttgatgtagaatagccactggggaagtcacggtcacggaagggaggacctgggggaggaggctctatacctgagccattaactgatctgtgatacactgtgaggagtgggtttacttttgcacttagtttttgtaatgtcactttgttagcatcagcacccctttgtctatttgtttttgagatctctgagctacttttgggttgctagaaacgttattttttatttttcgataggtgtttgctttttttgtggagtgttaaggtagaaaatggtaagaaatgtgaaatctctttgaaagatcagcattgcttgacttcggtctgctagatgttgtgctgtggtaaattttgtgctctgaatccatctaggtgcagcgtttgtagagaaatggggattctcctccagggaacctgttgctgctgttactgaaataattaccttcttgttaatatattattgcctgtgctgtgctttggttttattaatgcgatagaacttgccacctttttaacgtattaattttgtgttgacctttttaaaaataaaacttaggccaaggatttctaaggaaatttgattttgaggtttgttgccagacattccagaaattaccagttacacatcctagtacatgctcatcttgcaaccttaaaagcggtttataggccgggcgcggtggctcactcccacctgtaattccagcactttgggaggccgcggtgggtggttcacctgaggtcgggagctcgagacaagcctggccaatatggtgaaaccctgtctctactaaaaatacagaaattagctgggcgtggtggcgcgcgcctgtagccccagctgctctggaggctgaggcaggagaatcgcttgaacccgggaggcggaggttgcagtgatccgagatcgcgccactgcactccagcctgggcgacagagcgagactccgtttgaaaaaagaaaagacgagactccgtttgaaaaaagagaagacggtttatgacatagagatctgtctagtggtggtcagtgtgtttttacactctggtctactgaggcatgttatctgtactgtcctttaagtggaatgcagtttagcaactagtgcaggtatatatagtgaaatttttatttcatagttaatcctgaacttaatttttttccaaaaaatcgaaaagtggttcttgtatattaatctcgaattgcatgtgtctttgattaaacacgagccttaaagcatgcgtaaggacttcctacttcgttatctacaccactccaaaggcaaattccagtagttctgttagtttctttcggctgcctaatcactgttccacatggtgctcatttccatgtttacattgtgacaaaccatttccattttaagaaaaagaagagcaacgaagcagttattaaaagaagacccttcctttgttttctgacatgctggtgattcttgtgtcaaaccaaagtctcattttttaattgttcccagagagtcaagttggtgctttcctcccttcccccatatgcacactccttccccacacctgagtagttgtgttttttctttgtcttcttcaaggggtggggagaatgtgcttagtagtaatgactaacttttaataaaaatgtaggctccagtggcactcaggctgttgctataagtattaactgatgaaaagtaaattcagtatctggatattttaagggatgtcgatttccctttgaatttatcagagacttggctatagtatcttcagatacaattttcttgtttgttcttacgtattaaggatgtggttatcactgaactattgggatttttaaaaactccactactatattttacaataaaaaaggaaattatcttttagaagaagaactttagtttgacagtccttcactgctaaagaaagttaatcagggtcgggcgccgtctcacgcctgtaatcctagcactttgggaggccgaggcgggcggatcacgaggtcgggagatcgagaccatcctggctaacacggtgaaactccatctatactaaaaatacaaaaaaaattagctgggcgtggtggcgggcgcctgtagtcccagctactcgggaggctgaggcaggagaatagcgtgaacccgggaggcagaacttgcagtgagccgattttgcgccactgcactccagcctgggtgacagagtgagactccatctcaagaaaaaaaaaaaaaaaaggaaagttaatcagtaactgcacattttaaggggattatctattttctatttctactccttactcagtagagtgctgcattcagtttaagtgtatacactcactcagtgcaatcaagtcttgttttacaaatattaatacaaaagctgcagagcattttagtcttgacctttattggaagcctccaaaggttatatttcgacccagccaaaatataacctatttatattataggttttatatatatatgatatataaatatattatattatatatatatattatattttatatataaatatatattatattttatatatatattatattttatatataaatatatattatagtttatataatatataaatatatattatagtttatataatatataaaatatattatagtttatataatatataaaatatattatagtttatataatatatacatatatattatagtttatataatatatacatatatattatagtttatataatatatacatatatattatagtttatataatatataaacatatattatagtttatataatatataaacatatattatagtttatataatatatacatatatattatagtttatataatatatacatatatattatagtttatataatatataaacatatattatagtttatataatatataaacatatattatagtttatataatatataaacatatattatagtttatataatatataaacatatattatagtttatataatatataaacatatattatagtttatataatatataaacatatattatagtttatataatatataaacatatattatagtttatataatatataaacatatattatagtttatataatatataaacatatattatagtttatataatatataaacatatattatagtttatataatatataaacttatagtttatataatatataaacttatagtttatataatatataaacatatagtttatataatatataaacatatattatattatagtttatataatatataaatatatattatattatagtttatatatatatgagatatataaatatataatacattgtcagtcatcctgttttatttaaaagatcaagttctggaaaagaaatgaagaattttttttcagtgtctgtcaaaggggacatgaagaaaattgttagtggaggttaatccatatctatataatttagctgtaatttctacgtcaaagttaaccttcagtcactaatttggatccttttgtgcttacatagtcacctttaggctaactataacaagattctaggagttcctgatgctttttttttttttttaactcttcggttccaatacctaaagttatacacatgtgttacacagcttgtctggttaaattaagtgggtatggaatgttaaaaataatggtagggaataaatgaattacttaagacttgtttattccatgcatagattagtgagaacaattcagaaggcatactttgtagcccctccagagcagaaacttctttatttgacgactagaatagaaatatctttctaacaggtcttaaggattaaagttgatttttatggcttttaaaatgtttggaaaatgctaaccatttaactttgtataacagtagtattttctatgtgtcttaagtagagtgtgcagtatttgtatagtcaaagataagttctgtgacagtagaaagatgaacaagtctcattaaagaaggaatagattagaaagcataaaaatgttgcagtttttctactgtgccttgtttttatattgaccatctgaaaattaaattatagttttactttaattgtccacttaaaactttgtagctttgcagtactgctgtttcttttctggaatgctgttctcccttgtccttccctaggtactttgtttttagatgttaagtttttatgattatgattattattattttttttttggagacagggtctcactttgtcatccaggctggagtgcagtggcacgaacacagctcacggcagtctcgacttccctggctcaggtgatccttccacctcagtctcccaagtagctgggactacaggtgtgcaccaccatgcccagctactttttgtattttttgtagagatggggtttcaccatgtgtcctgaactgaggtgatccttcctcctcagccccgcaaagtattgggattacaggtttgagacactacgcctggccacatattaggtcttaatgcgtctaagcatcacttccccgggaaagcctttcctgatgtccccgcccctgtttcagggtcacattacacaccccgactgccattttatatttgtttctataactgatggctggctcctttgaatgctgtcagcctcaagaagctgagactgtttgtgatcacttttgtatcttcaatgacaagtttaaaagagcaaaaatatattctagtgagataagtgactcgattattgaagtagaaaactattaatccccagctgtaagcttttgttcttttaatcatgtgttttagtgtatttgttaaaagtgtatacaggtacaacacaaaatttacatctgcagcttaggtattggcaattatattttttaaaacataatcaattttactaatgattacatgagaaattgcctgatgttttaaggtagttggaacaagcttcatatttctgagactttaaagagttgtctttaacctacaagttgtcagaattgtctttaatttccaaatgtattgggtttttctctttcttgttggtgatttctaacttgattgcattgtgatcagggagcctaattaaaatcaatactgtacctggaaatttgttgaggctaactttattcccagcatacagtcagcttttatgtttcacctgtgcacaaaaagagtatacatattattgatgtgtgtgtctattctgtatgctctatgtccactagacttactgtgctgtttatatgtatatccttactaattgtgttcctctatttgatctgttgtatctaactgatcctctgtctacttgatggtgatgctaaaatggtgaatttaaaaattttctctacatttacaattagtattattttctaggtgaattgaagtttttatcattatgaagtgaacctctttacctctggtaatgcattttttcttaaagactatatttctaatgttaatgtgatttcactagcttttggtaaatatttcccagatatataaaagccaatagctgaattttacctttttatccagtctgatcttggtgcctgcctgtacagcattgtgtttactgatatatttggatttctgtctaccatcttatagattgtaggagcccactcccaactttgtggaaggtttgtgttataagtctcttttttccagtggttatcataaggatgttaacattaaagtctgaaattacttaatatcattagccttttcctgaattacaaaaagacataaggttatttaactccagtcatctcccccaatatgatcaattattgcccagtattttagttatatctttttcaccacaaattgaacattatttttatacagttaaatgttttagatctaatcatattgtactgtgtctttgcttactgtttcttcttacatttcagtcttttcttgagataatttcccttccatctaaaatgaattggaatttccattgagaaggtatgttgttggtaaatctcttatatgtctcttaggtatgaaaattaccctggtcttgaaagagttctaggttgacagcattttctcctagtacaatgaaggtattcttcctttgttttctactggctttgacatttgctgctgggaagccagttagctaattattgttcctttgtccgtggtgtgactcctcactggctgtttttaactttctcagttttagtattttgcagtttgactgtagtgtgtccatgtgtggattttagttgcacagcttgggtttcctgggtatcttggatctgaggacaggtgctacgttagttctagaacagtgctgttcagtgtactctttgtgatgatgttctacatctgtgccgtccatatggtaactgcctgcctcttgtggctaacaagaacttgaaatgtggttagtgtgactgaggaactgtgtttaaattttaatttcagtagccacatgtggctaatggctactttataggtgagtgcagctctagaaaattctcagcggttattcatgaaaattgccttttctccattctttctttctggaactctagtaacatgaaaaggaccgatggaaatctaacttcccatctgtcaacctgtcatgttttctttgtgctacattctggatgatttcatttgttcttaccttctgttcactattctttcctcagtcaggccaaatctgctcttttattcatccatttaattttcagtttcggttatcttctatttttagaaattgtatttggttctatttcaaatctgcttatcattcattatagtttctggttctttgctcatatttttaagcttctcttaagcatgtcaaaacattaatagttttccgtcctaatctcagaagtctgattcagccatccgtttctgcacattctcactcatggtgctttgttttcttgtgtgttttgtgatttgatttgatttttccttgagttgcttgttttccttggaacttcctctgtgggaatcctattacctagattgaggttgtatccttccagggaggatttgtgtgtgctgataccagtctcctggggacattacatccttggagtcactatatctttaattcctggcttaatgttttctcagccatactgggtagaataaatatggacctggcatctcaggagaaattttcctcatccccactactctgtatcaatgatgagacatttccttgcacacaggttttcctctttacccttatgctgaggtccttttggagtcccagcttgtagcttaatacaggacactttgtgtgttgcctcccctgcccccacacagtccccagagcacagagccaggctcccaggtttgtggagtctcccagcgggaaatcctgcctcagcacatgtgttctcccagggtttctgctttcacttcctttgtggcctctccggagcctttccttttgtgctaactcagcagtgtgtttcaaaaggtgtttagtttgtatcttttgcttttaatattttattcagcacttcagttgtttcagtctggcagtggctcaggtattagcttgctctagttgctggaacaaaatccaagtcagagcatctttatagcagactgtcaagtgaagggagtggaatatgtgcatgaaagtgttaatctgatctttgcagagggaaaggtcaaaaagttgttaagcattttggttgaaaccaaaccttcagtcaagctgtcaaactgtgggcatttcaaaactttccaattgatatttctttgtcatttttcttttgactattaaaagcacatgatagactacttactaatttctaggcattgtaaatgcagtgtttaaggatgctattcagtctgactgaatttttctaagttatttgtagtatctgaaaatcgagtcatatggtattattacccacagggacagtactcagaagtcacagatttgtgattgttcattaagtcagacacttaactttagggataaattaaagagggggaaatgcagcttcattctgttgcctatcacccgttgtcatccacaactcattcatttgaacttcagatgtgccaggtcctctgggatgtcagtatgaaaggcctgtccttgtactcaaagggcacaatgtcttgaaggagggcaggctgtctgcaggggcacagtgcaggctcctggcacagttcctcaagcccagaggctttcaaaggacccaagtcttgaaatgtctgtgtattagtctgttctcatgctgctatgaagaaatacccgaggctaggtaatttataaagaaaagagatttaaatgactcacagttccaaagggctggagaggcctcaggaagcttacaaatccatggtggaaggggaagcaaacatgtccttcttcacatggcagcaggaagaagtgccgagcaaaagggggaaaacccttataaaaccatcagatcttgtgagaattcatgagaacagcatgggggtaactgcccccatgattcaattacccccaccaggtgcctcccacaacatgtggggattatgggaactacaattcaagatgagatctggggagacacagccaaaccatatcagtctgttacttagtactttgagtgagttttaaaccttactctatcacttcagttgcttcaaaaatacttccatagtacagctccacagtctgcaagtccagactttgccttgtcagatcccagatattcagttcagcagacatttcagtagctattttgtgccacttggatgctgggaataaagatttggatcctccctaggacagttgacattcagatattaatgaattggtgtatttaaaatgtgcgagtttaaatgtatttcctaatttaaattcacagaaaaaggcttgaaaatttagacgtatgtataaatagttgcctattgcatagtggctgcacataagaagtttttttatgttttagtttgttttatagtctcaagattttaagtaatgaatatttgctgcttttgtaacaaggaaaaaaaagatttttttttaattaaaaacttactgtctttaggcctctaaagcagattcccaaacttatataccttctgttaatttgtttcaaattgtactaggttggaaaaattttttaatgcttacacatagtaagggcacttcaatagaagaatgctaatgcattcaggattacaaatattattttgtaattttcttaagtatggtacttaaggaaattttcttcttccaggggaaaaaaagagtatgttttaaaagtagctttaaaacataactgaaaacttactgaacaactagcactgaatctgaaggtgttacaaattgctgtttcataaatacattggtaattttacctgccaccatgtgccttctccctcaggagcttagaagaggcagggtggttaattctttgtggttaggcagggtttccagcactgcacttctcctcccgccttcctaaaccatgactcagattttagagtcaagagttgaataatatgattttacagttgttttgttgatgcatcagatttactttgtcccgtgactatctaccagtattgccgaactgaactgggtccatttgcccatgtagtggaaagccaaacactgaagcaccaggtttttgtagtgagagaggcttattgccagacagctgagcaaggagacaggagttggacttaagtctgtctctccacgctgggggctacgtcaggttttgtacttagaggtaatgaggcgtgatctgattggatcttgcagtggggtgatgctggaggcataatctgactggatcctgccatggggtgacaccagggcttgatctgatcggattttggatcctgccatgtggtgtccactgtggtttttttttttttttttttttttttttttttttttgagtcagggtctctcttctgttgcccaggctgaagtgcagtggtgcaacctccactgactgcagctcaacctcctgggctccagcgatcctctcacctcaacatcctgagtaagctgacaccacaaagtgcgtgccagcacacctggctaatttaaaagaatttttttttttttttgtagagacggggtctcagtctgttcctcaggctggagtgcagtggcatgataataactcactgcagccttgaactcctgggcttaagtgattctcccacctcagcctcacaagtagcttggactacagctgtgtgccacccccccggccaattttttaaatttttttttctttagtagaattgaggtctcgccatgttccccaggttggtctcaaactcctaggctcaaacgatcctcctgtgtcagcctcccaaagaattgtgattacagcctcccaaactgttagtgtccacttcttaattcagtgctcattcctcatgcccattccattccaagtgcccatctgagcacgtgggttctatccatggctgcacacttagttttgggcatgctctggtgatgtgacgttcaacctggaggtccatgccaactgaaaagcagctcataactttgttacataaaagttgaaccagattagtctgatgcaattccaacagtatgtaaagcgtattcaatgtccttgcaacccctaaaagctccaaaaccctaggaaatcaatacccgttaggttactgagatctgtggttacaataggttgagctgtctgaatcatctaaagccaagatgataccaaaaagtatagacattttaaatttaattttatttttgagacagagtcttactttgtcacccaggctggagtgcagtggcatgatctcagctcactgcaacctccacctcctgggttcaagcagttctcctgcctcagcctcccaggcaactgggattacagatgtgtgccaccacgctcagctaatttctgtatttttagtggagatggggtttcaccatattggccagcccagtttcaaactcctgacaccaagtgatccacctgcctcggcccctcaaagtgctgggattacaggcgtgagtcaccatgcccagccaagatttttaaaatattctaatatttacttctattagagttcaattactatataatgaccaaaagcaaagttttcagcctttaaaaacccattccccttctttttttttttttttttttaaatagagtcttgctctgttgcccaggctggagtccagtggtgcaaacatggctcattgaagccttgaactcccacactgaagcaatcctcctgcctcatcctcttgagtatctgtgatatggttaggcttcgtgtccccacccaaatctcatcttgaattgtaatcgctgtaatctccaagtgtcacaggagggaccaggtggaggtaattgaatcacggggtcgatttcccccatgctgactgagctgatggttttataaggggttcttccaccttcactcagtacttctccttcctgccaccttgtgaagaaggtgccttgcttccccttcactttccatcgtggttcatgaggcctccctagccatgctgaactgtgagtcaattaaacctctttcctgtataaattacccagtcttgggcagttctttatagccgtgtgaaaacagactaatacagtctgggaccacaggcatacaccaccatgcctagccatttattttttattttggttgagaagggtctcactctgttgctcagggtggagtgccgtggcgtgatctgggctcacagcagcagcctcgacctcccaggcacaagcaatccttctgcctcagcctcccaagtagctgggactacaggcacatgccaccagagccagctaatatttaattttttgtttgtttgtttgtttgtttgtagagacagggtctctctatgtgcccaggctgatcttgaacttctgggctcaaacattcctcctgcctcagcctcccaaagtgctgggattatagccattaccctttttgataagtggaaacatcttgtgcacgttctggagttttcattatgaaagtgatagatagtgattctctaaaatgctacaagtattaaatttttttctcaaactcccctcttctctgattcattaggactctcttctatacagaaagatatggcaatggtaataagcttccatctgagagagaaattgaactcttgctaaagtgatgatatttcctaaggattaggaattaatggtagagctgtggtactctaactagctgtatcacagtcaccaacccggggagcttgttaaatcacacagagtttctgattcaggaggtctggggtggggctgagaacacacatttcttttctttctttttttttttttgatacagagtcttactctcgcccaggctggagtgcagtggcgcgatctcagctcactgcaaactccgcctcccaggttcacgccattttcctgcctcagcctcccaagtagctgggactacaggcacccactaccatgcctggctaatttttttgtatttttagtagagacggggtttcaccatgttagcccggatggtctcgatctcctgacctcgtgatccgcccaccttgtcctcccaaagtgctgggattacaggcgtgagccaccgcgcccggccgagaacacacatttctaccagttcccaggtgatgctgatgctgctggtctagggacctaacttccagaaccactattgtgagggatggaaaaataaaagaaagaacttgggttctgtccttggttggtccctaagatctgtgaggccgtaaattgggtggctgcactagcatgccgtgtgcagtgaacacttgtgtcttgcttaaaggattattttatctaactgggttcatatgatgcagaaaatcacagatccgtaaaatattctcagaagctatttagtttctcgccaacttgtagtgttgtcagtaacttttcagttcttttgattgatcgttggtattatatgcaaaatgtctcaacactgttacaatctcacattaccatggaggctggttactactcttcctattgccttttaagttagccagaaaacatgcgatacagttttgtgtgttattaaaacagtaatcagtccagatttatttgcattgtataatatgttcctaccgtgattatataatgaaaataacttttaattcactaggagagaagaatcctgttcttaaattacttataagtcagataatacatgcctttgtgtaaatccagtttttaatgttatttgtgtggtaagtacccatacctaattttgatgaatttgaatttcagcggcttcatttttcctgtttgcccacttagaagctttaaggaagtaaagaaacaaatgtttgtcaaagctagaaaaaagaatgtagtccccaaactaggtaaatctacctctgaataatcaaatccacccatgtattattataggacccatatgcatgaaggcatgggcatgctgtctgtgttcatatgacctgtctctgcagtcagtaagaagtaacgggtgtctaaataagagaagggcagcagatcgtgaagccgtcgttggcatttaaacaaggtggcaactgaactgcactgttcagtttcttgtgggttccgtgaacagcatatgctgtaccattaattatggaaggaatacatgtaattgttggctgtggttaacattagaatattattatgcatgaacatcaagggatattgacagaaatattcagtatgctacattgcttccaaaaatcaaattttgtttgtttttttgagacagaacctcaccctgttgcccaggctggagtacagtagcagctcactgcagccccaatttcccgggctcgaacaatctttccacctcagcctcccaagtagctgggactacaggcatgcatcaccatgcctggctaatttttgtattttttatagagatggtgttttgccatgttgcccaggctggtcttgaactcctgggctcaagcagtctgcccacctcagcctcccaaagtgctagggttacaggcatgaaccactgtgctcgaccaataattttttttttttttattcaacagtctctctctagaatttatactgtaagtgaaaatgcatgtatatttttctatccagagaatttacagtctaatggagaacacagacacttagatatcttccattaggtgtacggttgctgtggtaaaagtatgtatacatagtgtacagtgagatagctcagtatttggagtcagaaatgagaccctctgacctgtttccctccatttagccattggaaacttaagagtaaaaataaatgtatatcaataaagagccatagtgtgaaaattttatgtagaagtgctaaatattctgacattatgttactcatgatgtagaagaggatcatttctctagtttagggaatggtgttaaatacttgaaggcatgtttagtttgaggtctcatttaaagagctcctattttagtgactgaccttgcaggacagaaagtacattttagagaagtgtaaatgtccactttccctggttgtactctaaaattttatctggcactggttaaactaagccactcttaggaaccagtgaacattcgaggcaagtagtctgtgcccaggcttgttctaaatcctttgtggccgaggacatagcgtcttggaatggttaaaatggatctgctccttttgatttccaggtaagctgttgtttgatgtgttttgtttacctggtttgcaatacccagagcttattctagagaagggattcccagctggtgaattgtcaggggatctttaactctttaaaatgtatatagattcggttaataaaatacaggtttacttaaaaacgctggacttcatagtacctttttggtgttaggtatcaatgaattgtccttgtgtataattactgttatatgtgtgtggggatgtatatatgtaatgaattaatgttgaggtcattggcattcctctgtgattcattatagctgttacataaaagcctatttcccctattagtgttttgtttctcttgaattttatatttagaataaaagagaaattatgtcttttattagagatgcaatgaatgaataaaattagttctacctgattatgaagcatatgtattttcatgtaatggtgatatagcatagagattaggagcctgggttcaaatcccagtccagttattaatacattactttgaaaagttacttactgcttcactttccttatctgtaaaatacaaataattgaatggattcaggtgtgaattccattgcacagtccaagtgggggaaaaattataattttgcttttctgtaataatttacaacaaattacatccccgtcctgctggggaagcagacctataatattttagttcccaggccaccgcctcttgcccagggtgaagcataatttgagggtggggatggtaacctagtgccatggccttgaaggtgtgaccccatcttgccctccagtctcctctttaggcctttcctcctgcccctcagtttagtaactctctccaccacttccttgctgtgctgcttgaggacatggtaaccaccttgctggttgtgcgcagtattggggcgtgaatctctgcaaagctcagacctttctgtcttaatgtgatacatagctgtttggattctcctatcctctccggttgtttcatggtttcactagggttctgaaagcaggtgaaaaaaaacaagaaagcctcactgggaaggtgacactcaggtagagatctgagggaaggtgggggtgtctttggatctcgggaaagagcagaccctcaggctggtgcttggggtgtctttggatctcgggaaagagcagaccctcaggctggtgcttggggtgtctttggatctcgggaaagagcagaccctcaggctggtgcttggggtgtctttggatctcgggaaagagcagaccctcaggctggtgcttgcacagtgaggccagagctgagggagctcagggaagaggggctgctccccaggctgaggaggcccaggcgaccacgggggctttgacatttatttggcaataaaaccattggagggttttcaccacacccaaaatgactgacttttacaaaaaatactttctttctttcttttctttcttttctttcctttctttcctttccttccttccttccttctcccttctctctctctctctctttctttctctttctttcttctttcttttttaaagagttgagcttgcctttattacccaaagctaactgcaggagttaacagtcagtttgctttgatactggatttaagccttattttatcccttcttaaaacttaattgattgtatcttattaaagccacactaggaaaatcctgtgctccatttaagtcaatcagtaagagagcttcagaaggattgacacagtatccttctctatatgaggaataccccagtcaaatcagctgggagaaaaaactttgtaaagaaatttttaaaaacctctattattttgcattcgagattttgtctgatagaaaatttcagattatgtttcctggatatactgaaagtgaatacaaacggctcatcagaccatttggctgttaccgttatgctgttcactcgactggtggccacatagacataagcaaagtacttgcagactgctggatttctgactgatgaaaccatttctgatcagcgactcactgcatttctcttccgatgagggtcactgtttgcagggtgtctggtataaacttcctgaagccccagcagtcttgagagcagcagtagaagaaagcagctggaaccctgagaactggggcagaatgctgttatgggctaagaagaaatggcatcatcttggcttagaatttggagattcaatgaatctttattctttcatggttccattaagtgattatttttaatatgaattagatcactggaatttcatattagtcatgctgaaaaattccacatctgtgtgttttaatttagggtcttcaagatgaagggcatcccccaatgattaggagaggcacaagatagaaatacagattttattacctacaggccctgggagtacacagcaatcctggaggtcacacacaggatggtcagggagcttgaaggtcaggaattgtgaagggagagagagagattgagacctacctagagacccatgggccttcatggggtccaaacaggtttcccccagggaggtttaattggttccaggaggtcacactgtgactgcacagcccatgtggggtgtggggatcggggccagtgaagtaggctgtgtgtagctttcccatggggaggtggttgccaggaggaagttgtctaaggcaggtatctgtattagtcatgttgaggaactgggaggaggtgtagaactgcaccctctgccatgtccagggtgacagagccctgcttctgctacgacaaggtcccacttatcttcaaagtgcatgctgaggcaacataaaatgataagaatttactacactgtgacttttaaactatcatctcaatggtttggcatgattcaatattttctattttaactttttatttataaaaattttaaacatggacaaaagtagaacagcacagtgacactcccctgtgtactcatcacccacctccacagtgatcctggcccgttttgtttcctctagcctcccctcccctattttcccctttcctcattattttgaagcaaattccagacatcgtttcatgataagtattttaatatatatctccaaaactgtagacttaaataactgtaattcctgttatacttaaaaattcagaatacattcttaatatcttcaaatatccagtctgttggtaggcagtgtaaacatattcataaattaagtttgctgtatctattaagttgcttgatagtattaaggtgagaacagtgccatctcttactggttgacatttgtatgagtctgcccatgttaatgtaaaacagatttgccacaggtaatgtgaccatacaggtaacataatctaacagttaaaaaatatatgcatgtcttgcttttatcttgttgactccagtgctcttatcaaaatcctcatgatgcaactgcccaatgggttcaccatcaccactgcctagacagaatcgatttatcaagacagggggattgcaatggagtaagagtaattcacgtagagctggctgtgcgggagacctgagtttgttagtcagtctccccgagcatttggggattggagtttttaaagataatttggtgtttttaaagataatttggtgggtaggggcttgggaagtggggagtgctgattggtcaggttgcagatggaatcttaaggggttgaagttaggttttcttaatgtcttctgttcctgggttggatggcagaactggttgggccaggttactggtctgagtccatcaagtgcagggtctgcaaatatcttaatcactgatcttaggttttacaatagtgatgttatccccaggagcaatttggggaggttcagactcttggagccagaggctacatgaccccgaaattgtaatttcttgtagttattttgttagtcctgcaaaggcagactggaccccagacaagaagggggtcttttcaggaaagggctgttaccaattttgtttcagagtcaaaccatggatcaaattctttcccaaagttagttctggcctgtgctcaggaatgaacaaggacagcttaaaggttacaagcaagatagagttggttaggtctgatttctttcagtgtcataatttcctcaattataattttgcaaaggtggtttcaaggagatgaagccttctaagcctttctgtacagcttaggtggtgccagcaatgggaggatgcttaggacaagggttgaagaattgacgaaaatgaaaattgaaaaagaaatatagctgacccttgaacaatgtgggggttaggagcaccgaccgcctgcccagttgaaaattaaagtataactttcgactcccccaaaacttaactactaatagcctgctgttgactggaagccttataacgcaaacagttaacacatattttgtatgttatatgtattacatacggtattcttacagtaaattaagctaaagaaaatgttattgagaaaatcataaggaagagaaaatatatttactactaagtggaagtagagcattaggccttcatcctcattgtcttcacattgagtaggtggaggaaaaggagggtggagtggcagaaatagaagaaacggtgcatgtaaagtggaccagacctgtgttgttcaaaggttaactgtactgattatcttattttaacttaaaatgtataatgtgcatttactcaccaatcctttgatagacagacagctatggtctttgtgtacttctgattgcagtgctaagtgatccattttgcataatccatactcaattcattgcaattctaattttttgtttcttttagaagagcttaaatagtttgaagacaatttcaaagcatcgtgagtacagaattctagattttaaaaaattatttcccatttgtcttttttttttttttttttttgagatggagtctcactctaccacccaggccagagtgcagtggcatgatcttggctcactgtaacctccaccacccaggttcaagcaattttcctgccttagcctcctgcatagctgggattacaggcccatacctcctcacctgcctaatttttgtatttttagtagagacagggtttcaccactttggcctggctggtctcgaactcctggccccaagctgtctgcccacctcagcctcccagaatgctgggattgtaaccgcccaatgggttcactttgcctgccaatttcttagagccgatttctcaggacaagcggaattgcaatagagaaagagtaattcatgcagtgcaggagaccggagttttattattactcaaatcagtctacccatagagtttttaaggacaatttggtgggtgggggaagccagtgagccaggagtgctgattggtcaggggtgaaatcacagggagtcaaagctgtcttgcactgagtcagttcctgggtgggggccacaagatcagatgcccagtttattgatcggggtggtgccagctgatccatcaagtgcagagtctgcaaagtatctcaagcactgatcttaggagcagtttagagaggatcagaatcttgtagcctccagctacatgactcctaaatcataatttttaatcttgtggctaatccttgttttttttttttgtttttttttttgagacagagtctcactctgttgcccaggctggagtgcagtggtgcaatctcggctcactgcagcctgcacctcccaaggtcaaggggttctcctgcctcagcctcctgagtagctgggactataggcacccgccaccacgcccggctaattttttgtgtttttagtagagacagcatttcaccgtgttggtcaggctggtcttgaactcctgacctcaaatgatttacccaccttggtctcccaaagtgctgggattacaggcatgagccactgcgcctggccgtcgtccttgttttaaacatctttgtttcaaactataaattcccaaagttcgttcagcctgcgtccaggagtgaacaaggacagcttggaagttagaagcaagatggagtcaattaagttagatctccttcattgtctcagtcataattttgcaaaggcaatttcaggattacaggcttcagccaccgcacctggccctttcccatttgtcttttttttttttttttttttaagacggagttccgctcttgtcgcccaggctggagtgcaatggtatgacctcagctcactgcaacctccacctcctgggtagaagcgattctcctgcctcagctttccgaatagctgggcttacaggcacccgctaccatgcccagctaattttttttgtattttagtagagacggcgtttcaccatgttggccatgctgttctcaaactcctgacctcaggtggtctgcctgccttggcctcccaaagtgctgggattacaggtgcgagccaccgtgcccggccccatttgtcttaactgttgtctcacttacacttattttgacagtaaactttttagccatctacttacatttcttggaaacaattactcttttttgaactcatgtttcattagctatgtaataattcagttgcatagctatagtaacttactgtaatcacaactggttcatggtaagtatatgattcagatggtggggtcagaatttcctgtgtatactagagagtatcctgcaaaatgcaggagttcaacatgccacatattttatacaaagcatagacggcattggtgaatctggtaaattgattgtgtagcatacaggctgtgtgatactctcccattagtcatagttttgagatttatggctggttcctgtggttgcttaggttggagtatggttcttgtgaactgaatattggactttgaaaagaattgatagtagatgctgaatttggtattgttttgttctttactcttataacttgattgactcccttaataaatcagtatcctagtgccatatcataatttacaaaatgatcagaggtgcttttgtaacactttcagtgttattgatttgcaagaaggatcagctggaaggcacaaaggatcctggcaaaattctggtgagaggcgcccgtcctgctgtgcaggtgtctcttacggccctcctgatgagattgtcttcggcttctctgccttcgcatctgatgcatccctcacttggtcaccttttcccctctgtcagctgctgttaggcaaaatctcttcctttgtccaagtatgattcattcttccatttttatgtaataaactttaagttagctcttcaaattttattttatttttccaacttaactctctttggcagtcttattttaccatatccttaagcctacatttgtgctgcattaaaagccagctgtagttctgtggtgaggtttatgttagctctgtgaatctagaaaagaaattgccctgaagaggaactgctgataaaaataaatcgtagttaagaatactggcctcaggccaagtatggcttaaagcagagacccatattcctcatgtaacctagttgtatatgtatttatgtcgatgaccttaaggggaagtatcattttgagtagcttaaagatcagtatgtttcactttagtaatgttctttacatactttgatataaagtatttaaattctttaaaaaggcccagagacttgcagatcatctaggctgaccctgtcatttttcatgtgtgaaagctgagagctgggaaataagtattcagtgtctttcaccttacacaataattcatggttatgatggtgaccttgagtcataagaaaaggttcttcttggcggagtgtggtggctcacacctgtaatcccagcactttgggaggccaaggcaggcggatcacttgaggccaggagtttgagaccagcctagccaacgtggcgaaacctcatctcaactaaaaatacaaaaatttgctgggcatggtgacgtgtgcctgcagtcccagctacttgggaggctgagggatgagaatcacttgaacctgggaagtggagaagtgagcccaggtagcactactacacaccagcctgggcaacagagcaaggctccatctcaaaaaaaagattattcttaattatactttcagagtaagctttttatgaaactaggagagtctgcaggtttttgtttttgagacagggtctggctctgtctcccaagctagaatgcagtagcatgataccagctcactgcagcttccacctcttgggctcaggtgatcctcctacctcagcctccaagttagctgagaccacaggtgtgcaccacactgcttggctaatttttgtatttttggtagagatggggttttgccatgttgcccagactggtcttgaactcctgagctcaagcgatctgcccacctccacctcccaaaatgctagaatcacagttgtgagccactgcgcccagccttgtagtacttattttaaaaagaccaagaaaaatgatgaggctaaagttttcctgatggtgtagatctttggaaaagctgaataacccaaatgctatatattctataggagttttctttctgaaaaatatatatttttaaatttcatccatttcgattgttgagtttttgggactaaagtggcaagcaggaatgtggggaggccttgctgggaaggagccaggctatgtatatctgtgctgatggattaataatttccacgtgggcccaggaaggagggaggaagcttcatcataggttacacgtcgtctattctggttttagtagtgctaaaatcctgtaacatatttttcagtatattttacttgtcggttgtgtaaatactccttttcatctctgaatgctaatttatttgcacaaaaacagcagcagggaagccctgttgaaaataaggtattaatttttataactctcttggtaaatgtacctttgcattatttggcctctggcattgttttgacctggctttacacagtcctttatctgggcctcctgccacctccccaccccacattctccctagcccctgttcctcactggcaagacccctcctcacctgcctgctgtaaagcccttactctgtcgcatcacctgattaacttctgtaattgcactcaccaccacctggaattgctttgcgtgttgatggctgtgtctcctcctaaaacaatgcttctgagagaaggagaacatcttgttcctggcttttcaccactatgtccccctagaacagcattcatggtactaactgcctattcaatatgtgttgataaaatataaacataccggctacctagcttcaatctggtagctagtcattggctttacccacccagagaatgcagaattttagaattggctctgatggctttaagcagaaaaaactgggcaggctattaggggaaaattcttcccccaaaccgtggtagagatttagaaaaagtgtaattaagacatgaaaaggataagcgttggcattttgcaaaataaagtttaatttgtaaatttaaaagtttaatgattgcctgttaaagtattggcttttggttcttttagctggggcagtaaacctagatgaagtgaagttttttatttaaaagaaactgtactttctgtactttgaaaactgaactagtaagattgaatttatttggaaatggcagtgaaacttgaactctgtaagcacctcttaggtggcagatgccgtgctacctggtaaatggctgtgtcaggtactgtgctgagcaggactgacagggagcttacagtttagagaatgcagacatgtccacaagcaacgatagtacagcagccgtaaaatgataggggaagggtagtgttataaggccgtccatgggagggatagatacgtaaccgattttgcacgtcataaaatgcttcccactggtgacatctaagctgagacctgaaaggtgagtaggatttggtcaggtgaagaaagagggaaggttgtgacatgtttatggaattgaaaatagttcaggccgggtgtggtagctcatgcctgtaatcccagtactttgagagaccgcagcagtaggatcacttgagcccagaagtttgaggctgcagtaagctgtgatgcaccactgcacttcagcctgggtgacagtgagaccttgtctcaagaaaagaaaagaaaatagttcaataagtctggaatttatcattgaaggtaagaattgtaagtgataaggccacggaggtgttcagggtcaggtgatcatataattttttagtccaaactggaatactttcaagaaaaaagagggtacagttaattacactgagataacaggcataaactggggctggcctggatagatgaggatacatggtcagcctctttataagccatgcttattaacattggggtttatttagtgaacagatagatgttgagcacctactgtgttccaggcattgtgcttgggctttcttgtaagagctgtgggaagcactggaaggtttgagtcaagagcggcaatgcttagtgtgcatgttcaaaaggtccttggcgctgcaggcggaagatgaattggagcaaggcgcagcaggtgtgcagaggctggaggaggcttttgaagtgaatgaaaataattaaagatgacttggactgtggaactcacacatgggatggagagaagtgagtagattgtagcagtatttagaaagtagatttgccaggcctttcttagaggtggaaaggaatgagaggaggagtcaagagtacctttcagtttctttttgggtgagtggataggagaagttccatctagaaggctggggaatgctggagagaaggcagggtctgtgctggaatgctgatgaggccttgcttggtgtgttgtgtgctcttggaactgcatgcaggaatctgataggtgacagattttcaagtctgaacctcaggaggaaagatctaagaaatggacttgggattcatcagtataaagatggcaggtgacgttgtcagagtggatgttacccagggagaatgtctagagtaagaagagtgtaggaccctggaaaacacagacatttacagtgtggcctggctaatgcctgggcaaggagagaaggtggaaaggaaggaagaaaaccagaggagggcaggtgtggaggggcgaggggaggagagtgtttcaagaaggaagagtggacagcaatgtcagacgcagtcaggcagtcaggtgggttgagggcctagcatggtgattggatttagcagtaagaaagctgccggtatccttggccagagctgtttcagtggtgtcagtgtgggcaaggcttgactagtgcagggtgaagagtgagtagcagatgaagtagacccggggcatgtggaaaacttctctgaaatttgaatttcttgatgttaagagaaggtattattcaaaggaatatgtggggttgagggatggtttcttcttcctttttaaggatgtgacagacaggtgggttaaacactaatgggaaggagagcgtggcgaagttgtaatcagtgcgtggatgggaggagtaaccaacagtcccagtgcaactgggtgggctcacatgcacattatctttcgagtttgctgggggagtctcttcccttggcttctcttttttttccactttctgaagttggggtaaaggtcatgggcctgttatgtaacccccaagagctcccttaaacaaaaatttgatagtggtgtttcattgtcaagctccatacatctgataatgcttggtgactgtatttaaaatattttatttttcctgaaggctcctggcaggtcacttttaagagcatatatcttctttgccttttcagctcatggcactgctggctgccaggggctgggcctgtgctggggtgcaccagctgtcagctgaataaggctaacgccatagaaggaaggagcatgcagttaggataccattctggtttattccacaattgtacatttttacttatttctatggtcttttgaaaatagtgataaggctgggcgtggtggctcatgcctgtaatcccagcactttgggagactgaagtgagtgaatcacttgaggccaggagttcaagaccaacctggcccacatggtgaaaccctatttctactaaaaatacaaaaaaattagtggggcatggtggcacatgcctgtaatcccagctgctcagaaggctgaggcaggagaattgcctgaacctgggaggtggaggctacagtgagccgagatcaagcctctgcactccagcttgggtgacagagcaagatggtctcaaaaaaaaaaaaaaccctaaaataaataaatataaataaacctctacaaagtatacaaaatcttagttaaaaaagaataaaaatagtggtaaaaatacataacataaaatttaccattttaagtatatgattcagtgacattagatacattcacaatgatgtgtaaccattgccactatttctagaacttttttcaccatcccaaatagaaactctgtattgcattaaacaataactccccatttcccactccctgtagcccctggtaacccccattctactttctggcttcatttgcctattctaggtatctcacatagtggaatcatatattcgttgtttttttctttttgaaacggagcctcactctgtcacccaggctggagtgcagtggtgccatcttggctcactgcaccctccacctccagggttcaagcgattttcctgcctcagcctcccgagtagctgggattacaggcgttcgctaccacacccagctaattttttgtatttttagtagagacgggttcaccatgttggccaagctggtcttgaacttctgacctcaagtgagtgacctgcctctgcctcccaaagtgctgggattacaggtctgagccaccgtgcccggcctgtttgtccttttgtgtctggcttatttcaattagcgtaatgttttcaaggttcgtctgtaatgtagcatgtatccgaacttcatttctttttatggctgaataatattcctttgtattttgtttattcatccgttgatggacatttgagttgctgccaccttttggctattgtgaatggtgttgctgtgaactttggcttacaagtatctgagtccctgctttcagttcttttgagtggaatttgctggatcatatggtaattccgtgtttaacttttggaggaactgccaaactgttttctaccgtggctgtaccattttatattcccaccaaccattgatttagtttgacttctgttgtttaaagaagtatatctgaattttacacatactccaaaactgtaattatttgaattaattggagtagaaattaatttgaaataatgaaatgtctgattactggacatcaaaagctgctttgcattaggccatggttctcagaattcacaatcctcctttccattttttcctccctccctcccttcctcctctcgctaccatggtcactctcagcttcacaataagcacgtgtatcttagggcatttgaacttcaaatactacagcacctcacacgtaagaactctgtaacagtagacctctatttccctttcctgtcctatgtgctacttttttgttttgtttttttgagacagggtcttgctttgttgcccaggcaggagggcagtggcgtaatcacagctcactgcagcctcaacctcctgtttaagcgatcctcccacttctacctgccaagtagctaggactacagatgcagaccaccatgcccggctaatttttgtatttgtagagacagggtctctccacggtgccctggctggtcttaaattcctgagtttgtgcgatctgtccacctcggcctccaaaatgctggggttacaggcatgagccactgtgcctggcctttgtatttttgtcatacattttatttcccagtattatagactccagaatatgttgttgttattgttttaaaagtcagttatcttcttagttttctttcagaaaaattaaatggtgagtttttttgtttgtttgtttgtttgttttgcatggcccatgtatttaccattcctggtgctcttccttcttttgtgtggattcagttttccatctagtatcattttcgttctggtaaaagcatgtttgacatttcctgtagtattgctttgctggtgacacattcttcctcagcttttgtctgaaatgcctttatttcaccatcatttttgaaggatgtttttgctgggtatagaattctaggttggtagtttttgttatttttcagcatttttaaggtgacatttggcttgtacatgttgttcttgagaattctgcagttattctttgttccactgtatgtaataatatatgtttttctcctttctctgattttaaggtttttctctttgttgctgatattctgaaacttgactatgatgtgtctttgtgtggttttctttgtggtttttttcctgtggaatttattcaacttctgggatctgtaggttatagttttcacaaattggaaatttttgacattacttcttcagacactttttctgtcttcccctccatcattctgggatttgaattacatgtatacagtaactgttgttgtttcataggtgactaactgggtaggggaatgtctggttcccttactatccggtgaagtagcagaaccaccttttgtaggaatcagttatcaggccctttactttcccttgaactctaggctagttccagaacctttggtggactggaaagaggaaatagttatgccacaatttttagtacatgcaaatgtacatgtaatgtttaaaaaaaaaaaacaacaaaggtggtgatagcctgcatttactgggccatatgtgccggtccctattctatgggctttatttttattacttcatttctcctttgtgtcacaaggcacaggcagtttgagaccaagactttaaggaattggtccaagttttcaagactggtgaaacagtggtgtgaggatttgaacctatgtgcctggcttcaaagccagcttatcattggtatgttgccagtaattccatttcctccccctttggggaagaagtgagaccttgtaaatacacacactggtgagggtgtgggagatgggtactctcaactgggagtaagtttctgccagttgtctctggggtttggtatttgctactgtttgattttaaactttactatatttgtattcctgtctccccacccccagtgagcatgcagttttacaattgggaaaagcaataaagctattttaatttgggggctggtggtgaagttattttcttagccacagcaaagtaagttttaatgtgccttgccctaggcgttaaatagtgggttagtaaccttgcagctgtgataaagaacaaagtagctatgctgatgtgaagagtcctaagagaaaatatgaataaataaaagtcctaaataaatgaaatgtagaagagcacataagaaatgttaagagtatgtaagcatatactgtgattctaattgcttctgtgcatgtgtgtgctttgactagttgtgtacatgcaaacacgtatggcaaatttataacattttgagggatattttaaaaatcagcactaatgccctttggcacttttagaaactgttcctttttaacttcattgtgttgcttttgttgttgtattaataaaagtgtaggtatgtatttatatacactgaaattattggttctcagaatgaaaagtctaggaatatggtttacccccttttatgtggcctttaatgcagattctgtttgccatctaatctgctttttagttacactttggagtgttttgtgctttgttataatcagggaagcattctttcataaattttgatgtttgcaacatgactctgagcatcctaggtagagacaatccaagacagtgctttaaatttttaatttttttgacgggataataggttcatgttaaaaaaaaaaaaaaaaccccacaacactacaaaagggcaaaaaaaccccactgaaaattcctttcctatctctcctctcctttagccatcttctttcctcaggggcagtgttacccatttcttttacattgttaccgagatttcctgtgcatacacaagcaaatgcatgtactgcatcgctgggccctctttcttacacaagtggtgtgcctgatttgttttctcacttaatacatatatattagagatcattccacaccagaaaagtaagcaaatcttgttcttttggctgcggtatagtactccgtttcgcagagatcccatacttgatgaactagtcctgccttttaggttgtgtttggtcttttgctattctgggtggcattgcagtaaatatgaataaccatgtatatatgtcagtttgcaaaagtctatttctagaggataagttcctagactttctcgttaagatacatgtgtgtttgtaatcctgataggcattaccaaattgcctcttctgttagcgcgatgtaaggatacctgtttccctaaaccttatgcccttaccagcatggtgttagcagagttttgctttcgttttttggtagactgataggtgaaaaataaactgtttcattttatattcttttctgagtacagttttacattttaaaaaccattcttttcttactgactcgtactctttatatagagtagcaggagcaatctttagtctgtgttatgaattgcagacattttccccagattgtcattgatttttgttgttgttgttttgagatggagtttcgctcttgttgcccaggctggagtggagtgcagtggcacagtctcggctcactgcaacctccacctcctgagttcaagtgattctcctgcctcagcctcccaagtagttgggattacaggcagccaccaccacgccaagctaatatttttttgtttttttgtatttttagtagagacagggtttcaccatgttggccaggctgctcttgaacgcctgacctcagatgatccacccgcctcggcctcccagagtgctgggattacaggcgtgagccaccacgcccggcctgtcattgatttttatcttgtttatgttggctgttgccaggcgggtatgttttattttgggtgaagagacatttctcccattctccctgtaaaagacttgtcgattttatttcataaagtctcctctactgcaagagtatttttagaaattctcctaagattttctttggtgttttttatggttttttaaaaagacattttattgtggagcatgccaaacacattcagaagtagaagagtataataaagctgtttgtaaccattatccacctttggcaactaaccagctcatagccttatttcatcaagaccccatcagtgtctcttgctcctgcattatttttgaagaaatggcaggtattttaacacttcatctgtaagtattttcatgtatacctctaaagatggggaggaaagaggaaagtcttttaagaatataaccacaatgctgctttgatccctaaaaaatgaatacttttaaatatcacagtcctttaagaattcaaatttcataatcatttctgcagttggactcagaatcctaataaagtctgcatattactatcacgatcaatcttctcttcatttataggttcccttacctcactcccaacccttatcccctacttgttttgtctttgggacgtatttgttgggatggatttctgtagtaccttgatttcttaccttaccctcattacatagtttaatatattcttttgtatttcttgttactaggatttagagggtgaatagattcacattctttttttttcaagtatatttcataagcaggattgtattccatcagaaggcaagtaatgtctgcttgtctttgtgatgcactatgcttagatgaattaaatctttggggattgaaaaaaatgatctcattctattattccttcatttatcagctgaaatgcttgtaaaagagaaacttttatctactacttggttacttaatagtacagttcttaaaggataaatggttgatttttttgcctttatttaccagttgtcaaaatgaattcatttcctaccattctataatgatgaccaattagttttatcatcatgaactcatgagtttaagcaaatttaatgtttcagtccattgtggtcattatccctattgatgcttgtattcttccacatttggacagcaagctcatcttcaggttggtacctgtgtctttttgacacaaccagtaggctttgctagtagtgtctttgataatctgataggaaaagatgttccaggcccatcttgtatgttttatatgggattcttgttttttcccactgaaacctggagtcaactatttctctaagtaaatctggttccttttaatgaaaaatgctgctcggaattcccaatctgggcactagatatgtgattaccttttttaaaaaaaaattaatctttgacccattatatgatttattttgttgggagaagtgaggtaggaattcatttttttccttcagatagttacttatttgttctaaaacaataaaatgccatctttatcatgttacctacgtttctatatgtctttgggacttgttgtggacttcgtacttttctagtttttccttgtttttttttttttccatgaaaaagattgggggccattcttgtttgtttatatgtccaattgaattttaggattagtttgtcctgtttcagaaaaaaaaaatcctatttgtatttttattagaattattgaaggagaggggagaggtgctattgatgatattggggcttctcatctaaaaatatggggagactctttgaatccatttgtattgtataacaaactaccccaaaacttaatgacataaaacaacaaatactttgtatttcttacagttctgtggactgacaatgcgtggttcttgtggtctggagagcccatctgaggctggatagtcttaggtggcctttccttcatgttagggtctcaccttacacagctaggatgatgcgggcctctttccatatggtctcggatctgcagagttactaacccagccaggttcagtggtagcacaggtgatcctggcagcaagagatggcagcccccaccccatgtataagtgcttttcatgcctatgttagtatcacatatgctatcgttctgttggccagagtaagcacatgaactcgtccggagtcttttttctttttcttttttctttttttttttttgagatggagttttgctcttgttgcccaggctggagtgcaatggcgcaatctcggctcaccgcagcctccaccacccgggttcaagtgattctcctgcctcagcctagcgagtagctaggattacagggacgtatgtttagtagagacggggtctgtccatgttggtcaggctggtctcaaactcctgtactcacgtgatccgcctgtttcgacttcccaaagtgctgggattacaagtgtgagccaccatgcccggccattgtccagagtcttaatgggaggagtgacaaagtcatattgcaaattggtattgatataggggtgggaggatttactgtggccattgttacaatctaccttgatgtattagcatgttctcacactgctagtaaagacatacctgagactgggtaatttataaagaaaagagatttaatggactcacaattccacatggctggggaggcctcacaatcatggtggaaggcaaaggagaagcaaagggacatcttacatggcagcaggcaagagagcttgtgcagggggactcccctttataaaaccatcagatctcatgagacttactcactaccacgagaacagtatgggggataccacccccatgattcagttatctccacctggccctgcccttgacacatgcagattattacaattcagggtgagatttgggtggagacacagccaaaccatatcacatactctccattttttccaattttctgtgttatttaagaaattctaaagtttttttccagataggttttacacatttcttaagtttattcctaaatatttcatcttccgccattactgtacatgatgtctttttcctctcattttaatttagaattcttggacaggtgacatacacacacacagttaaaattaaatgatatgaaaagaaatataatgagaaacgtcacttccacttgtgttatcactgagtttcttctcccatgtttctaggtgaccaatttaaaattaatttcttgttttatttaatgtttctttatggaaatactggcaaatataaatattctgctcatgaaaaaggtgtagcatgctatatgccctgttccataagttaccttttttgaccatgtattcattccatgtctgagtatatagattgttctcattctcttgttgctgtataatattccattttgacagcatagcctggtttatttaatcagttgcctgttagtagaagctatattggggtagcattccttagcatcagatttgcagaaatcgaaaagtggagtgatttattctgtttgtgaagctgtagaaaaatgttactttcgtatataatactggtagaagtttaaatagtacaaccccaaattgtggccgtggggatctggcaatgtctgccagattaatttgtctctcttagtgtgtgagattgagcgttttgtcatgcatttaagggccattgtattctttaatgaactgtttgttcctctgcccatttttgtattaggttgctggtctttttcttgagttccagaaactctttatgtatcagaagattaacactttgtgatatgaattgaaaatactctttcctttatgacttctgctgtatgttaagactagtgatttttacataattttgttccgggtcatgttataggagtcagcaaattttggcccatgaacaaaatctagcctgtcatgtgcagtttgtaaataaagttccactggaacgtggccatatccatttgtttatatattgtctgtggtggcttttgcactgcggcagcagagacagactgaatggcctgcaaactcgaaaatatttactatctggtcctgtacagaaaaaggaaaagcaacccctcatttaaagcaataaaatcaaagtgttttgtatgatacagccattttgacatggccttaaaaaaatagcctaggcaacatagtgagatctcgtctctttaaaaaaattaaaaaataaaatattagccaggagtggtggcatgtgcctgtagtcctgtctatcaggaggctgaggcaggagaattgcttgagcccaggagttcaaggctgcagtgagccatgattgcaccactgccctccagcttgggtgacagagcaagatgcggtctctcaaatacaataaaatatccaattaaattcaagttttgtgtgtttaattatgaagtaaggcacagcacaggcagtcacacgtaggtttcagaagtatctgttttgacacattacttggtaatcgtgatggtacatgtgatatggccagttgatgccaccacatcaaatcactgttaagatatctttgtctaattgttcttgtgtgcaccgcatatagaagctttgatctgggtgagtgtgggtagaatgactcttaaaatcatcccaatctctagaagtttggttacagtgtagcctcagtttgtatttcctgtggtcttaagtactttccagagctgttctgcacgagtgaactacagagagagggagagcagtttggaagagtatggtacaatttgatttatgtattttaagtactcagaactctgctcccctagaattgtacagtcgccttttgttacactcagatttaagtttacactaagtatttcttgggaatttgtaattctactcagggaatttctatttacatttctgtttgacttggaaatttcccaaactgcttgtctaattgaccatcagtttaaaaaattcctctaagtgcatttgtttcagaataacagatataaacctattttaggaaaaaacatttttaaagaacatatcaatttaccagtagtttattcttgaaaattttacatacagaatatttaaaaatttttattcattctcaattgctgctaccaattctttttagaaatttcttctgtttggaaaagatcttttgctagaacaactgttaaaatgttctatcatcttgactatacttttgaatggattattaaagaaattgcttctcaacatttaaggaaacttcatttccttctttggaaattttaagagcaacattctgagaacatgataattaattgacccgcatccccttggagcttcttatctggtgcagctgacttggccctgccatagtttaacagtttgaataatgacactggtgaaactgtagaaagcgtgctcatcaggctttccgatgactcccagcaagaaaagataagggagaattggatgatggcttcagaattcagaaagctcttaataggttggagcagtgggttgaatctaatagcttgaaattttatagcgataactataatattctgtatttagttcacataacagtggagtaagcgcaaggttgagcaaaagctgtggaaatcactgatatgcagtagtccccctttagtgacgggggatatgttccgagacctccagggatgcctgcaaccaaggataataccaaaccttatgtgtgtactatgttttttctatatatgcctatgacaaagttaatttataaattagatacagtaagagatgcacaagaataactaataataaaatagaacagttattatagtatgccagcaacaccactcttgtgcatcagggtcattattaagtaaaataaggatgacctgaagatgagcactgccatacctgatagtcagtctactaaatgggacggctactacatgacagtcaggtgggcagtgtctatggtgtagagatgctggacaaagggatgattcatgtcctgagtgggagagtgtgagattgcatcatgctactcagaatggcatggactctaaaactgataaattgtttatttctggaattttctatttaatattttccaactgcatttgatagcagttcactgaaaccgaggaacgtgaaactgtggaggagggactacttatattgaaaagcatttatgccttcaccatttagattaaggacaaatacatcaacatatgttaatagcataataatgctcagggtctgtgaaagtaagttctgtttcttctgatgatcttaataagtcaagataagattgaggaagacgttaaatattatacaattttgtaagtcatgaatgtgcttaagttaaacaagcttgccatttaaagaggtaaactagttatacatagaaatattacctactctttatgcaaaacttcacttctcgagggtgtcaaatcattctttccctggaatttctgaagatttacatattttattttttaattgtacttttctgttttaaagatgaggagcaacactgttgaagatttactgcttttttccctaagatgtaattgtgatttatatgcaatcagagaggtagatacttaagaatggggccttagcttttgcattctaactcccatatgaactttttttattgccagggttttgtgaattttttttccttcctattttgaactgttttattctctattgttgtgcattttaggatctagttttttggttttcatttttgcttaataaatacaggtagttcttagttcttatggccagtgtttttttaaattagaatgtttccttaataaattctttggtttggggttattggtttgtattaacttggactctctaggttgcaagtgacaagatgtggactgacagtttaataagctcatgaggagatacattggctccagtaacagagaagtcttccatggggagaatgagtgtcaagtttgtccttcaaacaggacactgtttctctttgtcattctgtgctacattgacttcgtttttcagacagactttctccacacctcagccagttagccattgacagcaataccagagagaaggagcactgtccccaactcccataccaaagagctctgagaaagaattctgattatccagtttccaaaaggaagggatgtggggcagacagaataacagatatgtacaacataggtcagatagaatgtgtatggtcatactcctctcttttctcagaagaggaggtatgtgttaagaatggattatgcacattgtgggcagatgtgtgcttgcacacttggtattctagtgtctggagcattgaatggagagctttgaatccactaatgtttattttactgataagtagattagtagttaatggaacagatacgtgagattgatgtctagtagccattcatgtcatctgtaatactttttgaaaggaagagattagttgtggttgacaatatatattgaatatatagtttggagttatccactgaccaggactaggtggaaatttagctcttagaaatagttgaagaatgagttcttgaagtatagctaatagtggaaaatgcagtataggaaaatggaccatttctttcaaagaccacatggaaaatagatggcagttggggttgaggccagcacctctgtctgtttggatactgttagtggtagacaagaggggtgagaaggggaaagtgagaaaacaggtggaggcaaaatgcaaggataggaaagagaaaagaggggtgctgggagatgacgcccaaaagctttcagtttaattgaagctttagcatctctaggctgaatggtcaatatgtttttttattgacatgttatacttatttggagatatggttattaaatccttttttctccaaaattattctcagttcagatttctaagaagcatctgtttaagtcttaattcagtgttttagataaacttacaaggtttataaacatttttctgtgaatgtccttgtctgttttgtgcttacaacaggagatctacgactgggtaacttataaagaacagaatttattcctcataactgtggaggcaggcggttcaagatctaggtgctggcagggtagggcccggctctgcttccaagatggcgccttgagtgctccctcctccaggggtaagggtgttgtgtcctgacacagcagacgggtgagcgagagtaaacccactcccacgagccctttttgtagcagtgttgatcccctcttgaggacaaagcctccgtgacctaaacgccccccatttgccgcacctcccaataccactgccttgggggttcagtttcaacatgagttttggagggtccaaaccctctaaccttagcagtgagtaagtgcttagtaatatttaagtgtgtgaggctgtttccatttctttctttctcacttgtttcacattctgcttcactacattctaagtttagtaaacaagaggcttaggtattctatatttggaaactaattggattcagctggatttttaaaaatttcagcaggattcttgaggaccaataacacaacagcaggttcctcatgcccgtgagtgtggctttgcttctcccaggctccactctgagggctcgcttccttccagcccgtcccctgcccgcatttctgtcctgtctgtcctcatggcaggaaggatccaggttgatgcaatgtgtttttaaaaaacaccagccgggcatggtggctcacacctgtaatcccagtattttgggaggccgaggcgggcagatcatgaggtcaacagatcgagaccatcctggccaacgtggtgaaacctcgtctctaccaaaaatacaaaaattagctgggtgtggtggcgcatgcctgtaatcccagctactcgggaggctgaggcaggagaattgcttgaatccaggaggtggaggttgcagtgagctgagacttgccactgcactttagcctggcgacagagagagactctggctcaaacaaaacaaaacaaaaacaaaaactaccgcagccaggcatggtggctcacgcctgtaatcccacactttgggaagccaaggcgggtggatcacctgaggtgaggagtttgagaccagcctgaccaacatggtgaaaccctgtctctactaaaaatatgaaaattagccaagtgtggtggtaggcgcctgtagtcccagctacttgggaggctgaggcaggagaatcgcttgaacccaggaggcagaggttgcagtgagcccaaatggcatcactgcactccagcctgggcaacaagagcgaaacagtctcaggaaaaaaaaaaaaaaaaaaacaccacataacatgacaagcagaattctgtccacttttgcagccatgtcaggaaaacacctcagcatggctgctttgttcttcatgacgccctgaggggagccgtcctgctggcctgggcgccctgccatgatctccactcgggtcccagcctccaaggatggaggtggggagctgctgggatgtcttgactcacaggctttcccaccatttgtttcttcccaacagtttactaggagaaatttcagacatggagaaaggttggaattgaataccatagatccaccatctagattcagtacctgctttgtcacatattcgtccatcagtccatcttactattttttatgtatttcaagatagcattttggcttttttttcttagtctgttatcactaaatatgaacctttattctcattaaaataatttcaggcatcattaagcaaatacatagaaagggcaatggccaacaaaagggcctttcaagttcttgccatatggtgggtgttcagtaaatattgttaaattagtgcacttgcattagccctgttagactagccctgtcgctaaacttgaatttgcctttgaggacaaacaattacttttaaaccatatgtttcctaggcgcatgtgatccccagtttataggatggacttgaggaagatagtctgtgaaagacaatcacttagaatttgaaaaggatttaaattatgtattatatattataaaggtatatataaaacattttaaacacataccttgtttttaccacggtgattctctcttgggatacatgcacagcagtgttccaaggagtcagtgtttctggaccctgtctcaaggatcctcttgaggaagagcctgcaagagcagtccctccttactccagccagaatagctttgtcctagtctgtcttatatgaaataaaaatttcatttagggctggtcatagtggctcacacctgtaacccaaatactttgagaggaagatctcttgagcccaggagtttgagaccagcctaggcaacatggtgaaaccttatctctacaaaaaatacaaaaattagctgggcagggtggcatgtgccagtagtcccagctactggggaggctgaggtgggaggattgcttgagcctggtaggtcgaggctgcattgacccatgatggcaccactgcactccagcctgggtgacagagtgaaactctgtctggaaaaataaataaataaaagcttttattttaaggaaacgttttaaaatcatggctgtttaggtaactcgaccagcacacactgccctatgtaagtcttggtatggtggaagagtacccaaatcttaaatttctgagttaatgtggctaaagatgctgcattatcattcttattagataaggagcagtgaacattttaatagcaagcgattcttctaaagatgtgtgaatcttagatgtgtgtgcgtgtgtgtatgtctctgtcttcagtttctgagagtcagtgttcccagaatgaacagtttgtgtatttccacttcttacctcctaagagaaagaagatagtctgttgttgttgttaatgaaataggtgtttgtttgtttgtttttttaagagactgcagggtctcactgtcgtgcaggctggagtgcagtggcatgatcctggcttactgtaactttgacctcctgggctcaagcaatcctcccgcctcagttttttcagtagctggtactacaggtgctggctacaatgcccagctaatttttctttaattttttggtagagatggaatctcgctttgttgctcaggctggtctcgaacccctggcctcaagcaatcctcctgctatttagtctcccaagtagcagggattgcaggtgtgagctgctgcactcaaccaaaataggtatatttcgagtaacttttttagggttgatctctaaatgcaatgtgggcagctgccagaaaccttccctgcctccggaacagaacagggctatcaccgttggtgttattcttcctcagagtagagcagatgagtcattttggtaatgtcttcctttcttccaaaacagccacagccactatcatgtttgtaccagcatgcttagaaagtgaactgtacaccttttgtgtttttactactctgtttgtgtttgtaacatcctcttttcctctccactcctgataggctcgggttatgtatgattttgctgctgaacctggaaataatgaactgacggttaatgaaggagaaatcatcacaatcacaaatccggtaagagaactgtacattcgagtctgattgtcccatgtggacttatttttaacaaatccggtaagagaactgtacattcgagtctgattgtcccatgtggacttatttttaagattttatttttttgtaagttaatcattcaaacccacatgatttttttcctgttgcttatgaaatattgatggtgaagtaagaagctgttatataaatacaggaaaaaagttccctaaagacagttatgtatgtaattgagtttattatgtctgcttattttgtatcttcttcgatatgtttatcttacaattttttaaattacttacaaccttttaggtaccccatagttgtcctggaacatggttcagtgtgtttacccctagcatgataatactgtatctctagaataagtaaaagatgatggtgattttcctaaatgtcttaactgattgatcctatcatcatttttctaagctcttttcctaaatcagattaggttgccagaaagcaatatacttagaccagctccagtggagttagctcagctcccagtggagttctctttgctgaattacaagttattgcctcagcttttattcaaacaagaagcaactctatgtataaaaagcatttctgcatctttaccaaaccctgtttgaaattgtgtacatatacatacacacatgcatcttcaggtacactcatatgtatacatatgtacacatagatacactcatcttcagatgtgtgtctctgcttatataactgggtttattatgccctcccagagaagcatctatgtgatctcttatctcaggttctttctcctggagattgggtacattttgtttcataaagtcaaatctttgtagactattggatttctgttatggtctgtgttgtcaggaagcttagaggcaaacataatattcatttgtgtccaatcttctttgcccaagattctgttacagttttttccattatttctgtgtgatacttgtctcattacatttaattgtcctttttacatgtaactttattgtaactgttcttaaaatatgtagcaaaattatgagatgaacatcatttgaaataatgtaacaaaaattgtatcaattaatagtatttcattgcaggcttatatagatggagaaggaacaaaagcagatagggagaatttgtctttgtaaactgagtaaaacttgaacccatcgttacctgctttcttcacctggctgatttcgtgacactgccctgtgcatgcctgtccttggtccacgcctccgcctctgggccccacactgcaacgtgtctcttctgtgtcctctccctcgtgaccgtcactcatacttaatgtgtgtgcagtcttgggagaggtaccctggagatacaaagacaggaaacctggcccttgccctgtgctccttgttttccagagaggtctgcatgccagtgtttcttactgaatgtttccagaagggaacttgttgtgtctgtgctgtagaacatgttggatcccacacacctctccccggcctcactggctgtcctcttgtgtccctcccctctctgcctcacgagtgttggggttcccacgtcattccaccttcagcccatttctttacactatgcggtctcagatttttgtattgccgtctctgtggtgatgactttaaacctgtatctgcagcttcctcctgtggctccagcctcagaggaggccagacaccttcacctagttttttcacaagcacttcacactgaccacgtccagactcagctcatcacccatgtgatgctcagcctactcctacttctctgtatttctctgtatttctgttgtggcgcctttccattcagtgaaccaaggcccccaaggctaagtcacttaaagccattggtttctctccctagagttttactctgtccagcctcttctctccaccctgcgcttcctgccagcgccctgagctaagctctcatcctcttgcctggaccatgcaccttcctcactggccttgcctcaagcccagggtctgtctaaacggccagtgtggccaggtcattcctcgctggcagcattttctgtcagctgtaggtctgtgagacaccccaccatgggccccatcagacctcgccagcctttccctgtgcacgtgcacaggcacacacacgtgcacccatgtacgtactctcacgcactctctcacattatgcatacccccacacacactcgcacacacccttatgcgtgcacatgcacacacatgcgcacacacctcgcaccctcatacacctctcatgctctcatacactttacatactctttcacgtgtgcactcttacacacacgtaccttctcactctcacctctcatgcacacccacagtcgcatgctcacacacataggcagcactcacacgtgtgagcacgcacacacaccctcttcactctcacttgccctcatccgcactcatgctgtcacacatacacctgcactcacacatgtgagcacacacacccctcactcacctgctctcatgcacacccacactcatgctctcacacatacacatatgcactcacacatgcaagcacacacatcccctcagacactctcacctgctctctcacatccccacgctcatgctctcacatatgcactcacgtgtgagcacgcacacacacctactctctcacctgcgctcacactcacactcatgctctcacacatgcagcactcacccgtgtgagtgcatgtacccctcagacactgtcacctgctctcacacacgcacactcacatgctgtcacacagatgcagcactcacccgtgcaagcacatacaccctgcagatagtctcacctgctctcacacatacatgcactcacctgtgcaagcacgcacacccctcagacactctcacctgctctcacacatatatgcactcacccgtgcaagcacacacacccctcagacactctcacctgccctcacacatacccacactctcctgctctcacacagatgcagcactcacctgtgcaagcacatacaccctgcagatagtctcacctgctctcatacatacatgcactcacctgtgcaagcatgcacacccctcagacactcacctgctctcacacatatatgcactcacccgtgcaagcacacacacccctcagacactctcacctgctctcacacatacccacactctcctgctctcacacagatgcagcactcacccgtgcaagcacgcacacacccctcagacacactcacctgctgtcatgcacacgcacactcgcatgctcacacagagctcctgtggaaggagagagtgagaactgtggcagtgccaagatcgaggagggagaatgaggaacggcagaagtgatggtagtttttgaatagtgagcatatttagaaaacgtactttatatgtcttggattgaaaaaagaatcggccaggtgcagtggcttacacttgtaatcccagcacttttggaggccgaggcagggggatcgctttgagctcagcagttcaagaccagccttagtaacatggcaaaacctcatctctacaaaaaatacaaaaatttagccgggtgtggtagtgcgtgcctgtaatcccagctacttgggagactgaggtgggagggtcacttgagcccaggagttccaggctgcagtgagccaagatggtgccactgcatgtcagcttgggagacaaaatgagacagtgtctcaaaaaaaagaaaatcactgggtagaaaaagattatgtagtaattttgtataatatgctaggtgtgcatgttctcattcataggtgggaattgaacaatgagaacacttggacacagggcggggaacgtcgcacaccagggcctgtcgtcgggtgggaggaggggggagggatagcattaggagaaatacctaatgtaaatgacaagttaatgggtgcagcacaccaacatggcacatgtatacctatgtaacaaacctgcacgttgtgcacatgtaccctagaacttaaagtataataataatttttaaaaatttttaaaaatgctagatgtgtataagttaaatagattcagttttaatcatagcagagattaaagattcttcagtcttaccttttttttttttttttttttgcagacaggctctcaccctgtcacccaggctggagtgaggtggtgtgatcttggctcactgtaacctctgccttctgggtttaagcaattctcatgccccagcctcccgagtagctgggattacaggtgtgagccactgtacccagcctcatctaatttctttattgaagtatttaatttttcttggtaaaatagcaacttgtcctcaagttgctattgtggtcagaaagtgacaaaagttgtggcttaaagtgattttttaagagaatgtgattattcagattcagattattaactaattagggcattattttaaaactgtaaaaactcttactatgttaagatgagaaagtgggacctgccccttaacattgttaataattaataataatatcaacattaatagtttaatatttagataaagtttcttccaaggatagcaacttctattctgaataaaagttacaatttttcctttgatcatagattgaaatggcaatactgggatatagagttctactttattacttagtttattaatattatttatccagaagaactgaggaaccatggatcagttcactttttctgcataacaatcctaaaacttactagtttaacccagtaaccatttgttactgcttaggaatctacaagtcagcttgatggttctcctgagctgcactgcgtgtgtctgcaatcactggaccctgctggggactgactggtctaaggtagcctcactcatgagtctgccagttctctgggttggctggctttgaatggggcaacagggagactgggtctctgtcatcatctagcaacccacattaattcgtatagcgacttgggtgccagaagagtcagctgaagtgtgcagaagcccttgaggcaaggttctggattccctggaggatttccacttgattctgttgaccagcgaggtggcagagggcagattccaggcctgggatgcgcatcccaccgcttcacattcagagctgcaagccacttttattatctgccgcagaccagtacacagacaagatgagggtcatctaatcatcagctgttttcaatctttgatcacttattattgaagtttgatttttcttgtttttaggttacatcattttctgaagtaaagagaaggcttaagaatttaagattttgaacggtgttctctaggaatgaaaagcttaatgttaattgctttttttatgtataacaattcctccacacaaaatttctccaggaaatctcaactgtaatctttttcttttttttttttttttggtgacttattaggatgtaggtggaggatggctggaaggaagaaacatcaaaggagaacgagggctggttcccacagactacgttgaagtaagagcttcctgtcattcattcattagagctcatctttgccaggcatctttttatgaattatcaacttacaagaagtcagcaactttttgcaaaacaaaatttccattgtaaatataataaatgttaactatataaaatatggaaactacattgaaatagaactaagaaaaatattacctgtagacccaagcttcaaagaatgactacagatatttaggttaagtttcttccagggatagcaacttttaattggtctgaataaaagttagtatttttcctttgctaatattatctatattataaatatatattataaattgtataaattcaataagatatatgaaattatatctcaatatatctgttaatatatacattttaaatatatatttatatttttataagcaaaatatataaattttataaaatgtattataaattatataaattataaatatagatatatatttataatatgacacatataacgtatttttcctttgctgatattgctgccatctataatattgtttattgtacaatagactcacagtttaaatagatttttttaagtgcatatctcagttccttctcccattcccatagacagaggggtgtcttgggggagctgctgtggggatctcctgggtagagctgttaggatggatacccaggagagcaacacagcagcctgggctggtcctgcctgggacacccccaagctgagccaaccacctggcgccccctgctggttgtctttcggtccctccaaaccgagcgaaggttcttggtaagcttgtctttcatgttgggtgacagaaagaagcgaaggtttcctgatgccctgtgagtacaactggagctagatcaagaataaaggtacctttggttcacctccaggagaaaagaattccccccagaggatgtttacctgggacctgtctgcagagtgagatctaaggccgtccttctgttgttgatagacagtgagggtggggagtcatgacccctcagagaatccgatgcaatctctaggctttccctcagaaacgtgtgcccatgcacacaccacagccttttccatacaactgcaaccccctattcacaggcccctggcctcactccgtaggtcttatgttgaagtcttgttttacttgtatgcactttgcatccaggagcccacaaattgacaagattgagaaaaatctgagaatttaagttgatattggcagtaattggattttctaggattctgcttatataaaggaatagtgattacagatattcttgggtttgcttacctttaagaatataaaaccccctctattagaaatagatcctgcaggcagaaaatcagtaaggacgtggttgaactcagcaccatcaataaattgatgtccacttagggacatctatagactgcttcatcaaaccacagcagcatacacattcttttcaagcttacatggaacattctctaagacagaccacatattctgagccataaaacatacctcaacatgtttgaaagaaatcatacagtgtctgccctgagaccacaatggaatcacactagaaatcaaaacagaaagatagatggaaaatctgtaaatacttagagattgaacaatccacttctaaataatgcatggatcaaagaagaaatctcgagaaattaaaaaatagtttgaactaaataaaaatgaaaatacaacccattaaaatatgagtatgcggcaaaagcagtgcttacagagaaatttgtagcattgaagaatataaaccctttttgacaattcttgcttgccctcgaagactccctgaagtgaccgtaatctatgaaaataattgcggctctttctcctattcagattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggctttacggaaaacagagcgtatttgtgaaggcttgtgatgcattatagctattgccattccccaaaagcaaaaacaaagtcgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagaggaagaagaggaggctcttgttgttgaggaggtcagtgtcagagcctcggcctggatcaggaaatagatgccctggccctggcatgttgcttacactctcagagctagaggccctcatcctgcgagtagaagcagtgcctgtgaaagtctaccagatccaggcactcagcacttggtactcttattgtattgcttccaggaaacttagaatagtgggataacttgagaagaatacaaggaaattttacattaattttaattaaaatttgactagtttaggtgaatttgtctagttcatttattgccaaatgatgacacagagtaagtgacaagaagaaaattgagaagacaggtatcaaaatattgttgctgctgggcacagtagctcacgcctgtaatcccagcactttgggaggccaaggcaggtggattgcttgagtgctggagttcgagacaagcctgggcaacacgatgaaaccccatctccacacgttaaaaaaaaagttaaaaaaaaagaattaaaatattgttaactgcttacatctttagaaatgaatgggctttaggagatgttatttcttgattttttttttaactacataaaaggttttaaattctatcaggcctgatgataatcatatcacttacaagtatttgcttataaaatatctgtttattagccaggcacagtggctcacgcctgtaatcccaccagcactttgggaggccgaggcgggcggatcacctgagttcaggagtttgagaccatcctggccaacatggtgaaaccccatctctactaaaaatacaaaaattagctaggtgtggtggcaggcacctgtaatccaagctgctcggggggctgaagcaggagaatgacttgaactgggaggcggccactgcagtaagccgagatcgtgccactgtactccagcctgggcgagtgagactcctcaaaagaaaaagaatatctgtcaattgaccttccaagtgagtttatataagtttatcaccatatactaactgcaggttttatacatttcaaaacagctttttgtagacattctgaattacaaattagactcagatatttaaaatttgcaggcaaggtgattgatcactgtaattgaagaattctcttctgtattttattattctatactacttgagaacattggccaggtaagggttactcactgtgaaacgtgaatagtagttatacctcactggaagttttcccaggggttctcaacctgagcctcattgccgtttgaggccccgcgccctttcctagtggggcgggcccatcctgggcactgcaggatattgagcagccttcctagcttctacctaccaggtgccagtcacatgcacgccacctcagttgtgacaaccaaaaatgtctccagatatagccaagtgttgcctaggagcaaagccaagccagttgagattcactgagttatacagaagcacccatgaaatgggtttgcattaataaaggacaagattttaataaaagaattgtaatgaggtaatgagatcatagaataagtgaggcaaacaaaaaatagaaatatttatcttattttaattctagggactgaccagctattatctcaagataggtggaggcagtttagctaatgaaaagaaattaaaactcagatttaagtcatgttctgttaggaaatatattccttggtatttacttgtagtttaatataaactggtataagtctaaaatttgtttcgtttaggttatttagaaggtaataaaagaaaaaaaaagcggggggggcatctagtctaacattgaatctaatcagatcctttgaaagcaaagaaaaatgaactgaaactagaattaacaaaatgcagaaagcatagccgtcattaatttgagcatttgaatttaatgtaaatcaagtaaaaatattttaactgctatctctgccctctgttatctgggatatgagaacaatttaagtaggccaaaatttgggtacattttgtaaataccatgaaagatgtcacgagtaggaaaccagatgaccattaattggtagctttttaaacattttcctatcaggtttgcccattgctttcattttctgaatgcgggtaggaagatgtgtgctctgaggtgagctgcttgggaggctctgattgcctgtgctctctcccagggtcggttttgttttgagagcgggaacctcagagaagctgggcctctctcctgtccatcaggcccatgggcacatcccctctcaggcatgcatctcttcagcttggcacactctgccaacttctgagccagtgtctctttactcatcttagcatcagtaagtttaaatttgactctcctcccacacaagcaagttgaagccccacattcagttggttatccaacttcctgagtgtcgtatttttctttaagtatatctttttaaagatctctttgaataacttatttcgagcctgctactctttccttgactttgtattcttaatctgtgctgcatttcagagtaactagttcataaatgtataacctactatgtaagatagcactttcttttggtttttcttaaaactcctaatttcaggttgcttgggggaccctttggttctagattcttactgagtagtctcaggtgagcagagttgctggtgtcaaggcagtgttgctgcatccaggtccctggcccactgtgattgctttcctcttttggtggtgagaaaacgctttatcagccaaaacgcagttcagcttggctgcagtttagactagaattgtcagtgtgaaaggaatatgatgagttgttctttaaatggactgaaacagtttgatttggaaaattataaagctgtttattaaactacttggagaaaataatagacagcattttttttatgatcttggaatatggaagcccaccattttttttttttttttgagacggagtctcgctcagtcgctcaggctggagtgcagtggcgtgatgtcagctcactgcaacctctgcctcctcctgggttcaaatgattctcctgcgtcaatctcctgagtagctgggactacaggtgcccgccactacgcccaggtaatttttgtatttttggtagagatggggtttcaccatattggccaggctggtctcaaactcctgaccttgtgatccgcccacttcagcctcccaattgcatccggcctatggaagccctttctgagactgacagcacaaagtctagtggccattaaggatataattgatacatttaagtaaacaagtaatattaaattagcaaaaatacttctgacttatgacggatacaggctaattccattcatatacatacactcttgctaatctgtaagaaaaagatgaagaattcagaaaaataggtaaagtgtataaacaggctgtcctttggtgggggaaggtactaatagttaatatacttgggaaaatgctcattttaagattcttctatcaaactagcagagaatgaaaacagtttaaaagctagtgtcatacaggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgtaacagcagaaaaccggaatgtaaatgtctgtcagcaggggactgatcagatgaactataggcagccacgcagtggaaagctgagcttcccttagggagagtgagggtagatttagatgtacagatagaggtatgatttttttaaaaggcacctcagtatgggtaatgttatctttcttgtgtttcagtgcacacacatacacacacaccatagatgcaaagtgtgtagaaaatgtattgaaggatacccaggaactgaatcaaactctcttcattttcttattcaaatacagattttatattacccagataaggacaaccattttattacctttgaaaagaaagcatagtttttagtggttaatattagtttcattattagttacttatcggttatttcacagtttcaagagtatttcacgttagtggctgaaccactagaatgaatggaccagctgatgggaatgaatctcaattgttaaaaatctctactcctgtgtgtgctagtcttgtttttcatcagttattgttgtttagattacatcactgctgtgattctgaaaaggtttcagtatagatcttaaactctcagattactgcttctttagagtacttacttttgagaaattaatagaaagtttttgtttgtacctttctaaagaatgagaacaatgaggtttaaaagctacttaaaagttctgtaaacctagatgtcttatctgaaggttttctacttgagaggtttgttttctgtctccttcaaatactagaaagatgtgtatacttggaataaagctgcttttgttttgctgagagcccttctggcctctgtcacatgctctccctggcatctctctgtttttctgtttcacaccccgccagtccccaggtgagtggtgtggtgggaagcatgtaagctttgctgttagatccaggcttgccagtgcggctccactgtgtaagaattgtggctttggcataagacctgcctcctgaacctcctgaatagtcagtggattaggccaccaatataaagtagtgccggacacatggaagatatttcataaatattttccttcttttcccacttcttccctcctttaaaagggggtcttcaatccacttacccttttgtgttccagcctctctcactattctaccctctctaatcgtgtagattcccttataaagtgtctctctaatcttgaattttctctttgatttgcccaatttctagctttttgttgaacagttctatcagcatgtctcctttgtatctgaaattcatcttcaaccgaatcacttatttccccacaaaactagtttctcttcctgactttcctgtttctgtttctctgaaatgttacttctttctgtgccctctttttattctgctttaaaaccctaaccgagtgccatcgtgagccacagttattgagaggcgtgctctgcatccttgagatgtggaaagagggaactgattgagatccattgttctaacagatttcctgtcttttctctcctccttaagaggcaacctagcttggtgtcaaggcagtgagtttaggagccagactgtctaggttttaatcccagatctcacacatcctatgtgaatcagggtaagctgcttagcatctctgtgcctcatctgtaaaacctcatgggatttttggaaaaagtaaatgaaaaaagagttctaaagtatttagaagagtacatggtacttagtagtggtttaataattgttaattatagttatctcatataccactgcttctaaaacaagacattaaggacaggcacacttcatttattgccctttgctttattgcacttgacagataatgcattatttacagattgaaagtttttggcaccccctgcattgagcaagtctatgggcgccattttgtcaacagcatgtactcacttggtgtctctgtttcacgttttgttaattcttgcaatgtttcatactttttcatcattattatatctgttttgatgattcatgatgagtgatctttgatgttactattgtaattgttttgaggcaccacaatggcgagcttaattgacatgttttatgtgttccgcctgttctacccgccagccataccctcgtctttctccctctccttggacctccctattctctgagacacaaccgtatttcagttaaccaattattaaccctgcagtggcctctaagtgtttcagtgaaaggaagagtcgcatttctctcactttaaatcaagagctagaaattattaagcttagtgaggaaggcttgtcaaaagctgaagcaggccaaaagccaggtcctcttgagccaaacacttagccaagttgtgactgcaaaggaaaagttcttgaaggaaattaaaagtagtagtccagtgaacacttgaatgataagaaagtgaaatagccttattgctgataaggagaaggtttgagtggtctgggtagaagatcaaacaggccacaacattcccttaagccaaagcctaatgcagagcaaggtcttaactatcttcaattctgtgaaggctgagagaggtgaggaagctgcagaagaaaagtttgaagctagcagaagttggttcatgaggcttaaggaaagaagctgtcttcataatataaaagtgcacggtgaagcagcaggtgctgctgtggaagctgcaatacattatccagaagatctagcaaagattattgatgatggtgctgcactaaacagattttcagagcagatgaaacagccttctattattggaagaagatgccatctaggacttgcacagctggagaggggaagccagtgcctgcttcaaagtttcaaagaacaggctgactctctttaaggggctaatgcggctggtaactttatgttgaaaccagtgctcgtttaccattctgaaaatcctaagggtccttagaattatgcggaatctactctgcctgtcttctgtaaattgaatagccaagcctggatgacagcacatctgtttgcaatatgatttactgaatatttcaagcccactgttgagaccaactgctgagaaaaaaagatttctttcaaaatattactgctcattgacaatgcccctggtcacctaagagcgctgatggagatgtacatgaagattgatgttttcatgcctgctaatacagcacttattctacagcccttggatcgaggagtaattttgacttctaagtcctataagaaatacatttcgcaaggctatggctgccataaatagtgattcctctgatggatctgggcaaagtacatcgaaaaccttctgaaaaggattcatcgttctggatgccatgaagaacattcatgattcatggaagaaggtcaaaatgtcaacattaacaggagtttggaagaagtagattccaaccctcatagaagatgttcatgaaggaagtaactgcagatgtggtagaaatactaagagaactagaattagaagtggagcctgaagatgtgactgaatttcttcaacctcatgataaaacttgaacagatgaggagttgcttcttatggatgagcaaagaaagtggtttcctgagatggaatctattcgtggtgaggatgctatgaacattgttgacaacaaatgatttagaatattccataaacttagtagataaaatagcagcaggatttgagagaattgattccagttttgaaagaagttctactgtgggcaaaatgctatcaaacagcatcacatgctacagagaaatctttcatgaaaggaagagtcaattgacatggcagacttcattgtcttgttttaagaagttgccacagccaccccaaccttcagcaaccaccaccctgatcagtcagcagtcatgaacatcaaaacaagacccccccgccaccccagcaaaaagggtgcagcttgactagtggaaggctcagatgatcgttagcgatttttagcaataaagtatttttaattaagatatgtattttttatacataatgctctcgcacacttatacggtatagtgtaaccataactgttatgtacactgggggaccaaaaaagtccacatgactcactttaacgtgatggactggaaccaaaccctcagcattgctgacgtatgcttttatgtcatctccttgtttaagaaacttcagagtctcctctattgccttctggaataatcatttgctacatgtcagcagggctatcccaggagaaggtctttgtgtatcagagttaggcaagcagacgctgaacggttcatggtagggaaactgtagaagaaattcatctgaatttgaggttgaagtacttttccaagctcagttctatttctgtgatgcctcagtgtggctacccatcatcaccttatctttaagttatgtatttgtctccaggcaaactgatgattctccaaatatgtcccatgctgtctcaccttttatttgtacctttggcttgctcttctgagaataacagagtgactccttccatctttcagaagcccatctcttcaggttcagctcaaataccatgtcttctataaaaccttttgttttctgttttacttctctggattcccttagcacaatttgtgactcttatacaaattatattgcttatttgtaaattgttaagcttgataagcaaagaatttatctttttttctattcccagtgacctataagagactttgtaccataatactctgttcttgtttgaataattttttttcagttataaatacatcaaaaggtactttacaatgtaaggtattaaaagacttacagatttcctgaatccctgccttggagaagtttgtgttcttaacaccgaccacaggcctaggagctgtccatcactggcctgttattctcccatctgacgggctacccaatcaaaaatgggaagattctcttacagaaaattctctggcattgttatttttttaaaacagtttggatattaaacaaatgcttgaagttaagtggtatttaaggatataacatttttctctacagagattttccatgtaattatatttgttgcaaaggaatttttattggttataggatgaggaaggcaatggtaattttatgttggaactacattttgctttcttagttctcaaaagtctatttttaggccattttaggccttttttggtagtccatttaaaaataaattgataaaagaaaccctcacaaaggttcagtattagatgtgcttataccttcattaactcacataagtcttataatgccttagacatctcgtaattgcttattgagactttctctttacagaactttattgaaaaggttctttccatctcttcactctcactcccacccccccgtatgaattctttttagttggtaatagggctttttaaggaagatcatataccagtgttagaggatttatggacatttgccttcagaactgcatgaggctgtcattactaaccttgtgtgctttttcacagatccctgacatctatgagacagctttgttcatctcaggaacctttcaaaaatacatgctggtgaagtttgttatatagggtggtttttgtttgttttgtctaactggaaacaaactattaaagcaaagtctttttttttaaccttaaaactgcagtgatgaaggaccagccagcattgttatacgtacatcctgtcatcagcacagtgtaaaagcttatttcacatggacttctcttaggtctgtctggaagcaaattatttgctgattgtagcgccatcctattctgtactcaaagctacctattttaggactttgagctatctgagtaagtagactctctaagctaatacaaacattatccatttaccttaagtaaatttttagtgttttaattatctttatttaaaaaataaacacctgaaattgacatctgtaggttcagaatatgacttaacaaaggatttgttaaataatttcacctcttttggtaattcccaatcagtaatgttgatatgactggctataaatagattgagtctgctgtgatctaccttcatttttagaagaatgtacaagttttatgttccaccagtggttttctaacgtcagtacagattcatctgtagaattaggtcatgtcctttgagccaaagatctgtaaagaacaaaacaggaaacttgtcaaattcttccgtattttgagctaaagtggttagatttttttatataagagaatattataacctcttcagtcccttttgaggaaaagagttaaatttttgtcagaaattctggtttagatgttctctggtttaagaatcagatattatttgctttctattcctacttcctaacacagttgcacgtggtatagtcgtaagatgggccgtggcatgataggccagatgacatcatcacaggtggtgtggaaggatgtgacaggcacagtgaggagttccttatgtggtgataggcggacccctgaatgcctacagggccccatcccaagataataacatagaaagtagttagcctgcgattgggaactcctcttaactggtggacttaccagatgggatgatctgtactgacctgaagtggacgtttggtgtctgctggaaggaattaggtggcccataagagctgcgaccactcacagtatgttttgagctttcatagaccctttgtacatgtttggtagaaagccaaacggaaagcagctttaattaaatatgttaccattttcattaattcttaaacctagccctccttcgaggcctgatgtagttacgatggagacagacagacgtcgtggtgccattgctcatctctgccacgccacagttgctgttctcatggtctgtgcagtgagaactcttcctcttgggccatgtcttagctgcttactaggaaaccagtgaactgagtcaggtctaaccatgtcatccaaacaagcgcttgccctgcttactgcatttttttgttgtcagaagtaggggtttatttcttactggtcccagttccccaaggatgtcatatgaggagcaagaatacaacataaaaaaaaaataacaaaaccagaaactactatttttgtggtcagcagttgctaattagcattattactgtctttaaaaacaattagtaaagtaaccttttattttattgttacagaagcagtacatatgcattgtagaaaattcagactagaaaaagaaaagtatcccatttccacaatcactactctttacactaggtgtcttattttctctctgtgaacgtgggtatacacacaaacatacagatataaattgtatataaatggtaatggtttaccaccagttggtaatccttgccagaatcagaaatgttattccttccacgcttagctggtttcatctagaaagcagcactttcctgtatcagctggagctagttaattatgtcgaattccaatttggaattcaggatagatggctaattccacctctccttaattgccatgtttcaaagtaagaagttattttatagctactacaaatagtgaccaatgaagaaagcattcctgtctttttttctgacagtagcatggatgtatggatttacattgatttcataatgtgttttgttttttttttctttgtgcttaaagttatcaccttttggaagcccattcaagctgagtcttctacctcattaatatttgaaacctctcttgctcttaaatagtgctaagtctttcatctctgtcagtactgtatcagcttaatctttctcttcattatgggtcatattttccttgcttcttttcatgtctgataaattatgagtggatgtcagacattgcaattttcaccttgctatatgctggatatttttgcattcccataaacatttttgagccttgttctgggatgcacctaagttactttgaaataatctgattatttcaggttttatttttaagcccagagcaacatttagcttagggatatttttgcccctttcctgaaacaaatcctttgtagtattgtacccgatgccccgtgaatcatgaagttttccatctaggctggtgggaatagccctgtgtgaggggttgcactcttgattcactcttgattcttccgtgtgtgtctttccctgaccttgggtagacccctcacgtgatgggctgatcagtgcagatctgcagtgtcctctgcagtctccagagctctctctctgcgtctctgtcttccccagactctgtatcctcccaccacagagaccgccgagctttgtgtgggttttccatgcctgctccgtgtcctggagagtctctccacgcagtgaatgggcacttgtgggcttactctgtctgtctcccgtatctcaggatcacttcttcactgtctggtgtccagtgatttgaacacggtttcctatatttcatcatattttttgttttcattgggagcataaactgggtccctgttactccatctttgttgtctgctttgcgtattaactgattttcaactccaagtttattttcatctctcaggtgagaataataccaccgcttatttcacaggagagttgcgcctgaaaaggatgctgtcgtccactatataaatgtttgtagtactgacttccctacaggacagttgtggaaccgggatttgaagcctggaagctgggctccagaatggtcctcttaacacatctgctgcagtttacccatcaattggcttcttggaagcgcatcagtcagttacctcttctcacaagatgctgtattgtaggccagttagaccctaagagcacacaccgggagacattgtgttcacagaccagctgggctgttgtgtcattcacagctgcgattggtaggactcactgtggctctgtggttagcttcaagttgaccaggtggctttgctgattttgtctggactctctcacatacatgtctaatgcctctgaaagcaaaaggttcagaatattaacattttttttaacttggctatttctgttttttcctctggagtttgtttctctggctgtatgacttgcatgatacttaatccattctttctgtgctgcttatagttatttttagggtttcattaatactgtatcatgatgccaaacaacagactttagaaaatataatgcattgaagataacccattgctacacagttggggctttttgcatgtaatgtttgtgagtgagtggcatgctagagttttctggagaatttggtcctgccatgaatgtgctggttttagttaaaaactttgacctgctttttcactcttgttcactgggcaccttttttattttaaggtggatattttggctcagattggttgtgtcgaaagtctcagccagtcaccaccttcttctccttctccttctccttcttccatatataaggtaaatttcaaacttgaacacaagaggaaataaacatttaataaaccctaaaagtcatctttttttcccaagtgaagtgattatgtcaggtaaagtatcttacaggagctcttcttggggcatggtgatgtgggatgtggaatatgtaggaactgggaagatcgtgaggatttacaccgtggaggcctcttagaggaggcttgattactgaattcatcccacgggcagtgagatctaatgaaaggtctttaactctgtggttgactgtgaggaggagtgtggtaccacggagagagggaaaagaagaggagaatgaagacattgtcctgtaaaaattcaagaggaaggggaggtgtaaggaaagaaacgaagaggcatctcagcattggaaacctgagtgaaggagccgaggggattattgcatgaccaaatgtctgcagttgagagaccaaaggggttgtggggatggagaacaaaaatgtcagagacatcaggcgcagtggctcacgcctgtaatcccagcactttgggaggcggaggcaggcagattacctgaggtcaggagttcgagaccagcctggccaacatggtgaaaccccatctctactaaaaatacaaaaattagctgggtgtggtggtgcacccctgtaatcctagctacttgggaggctgaggcaggagaattgcttaaacctgggaggcagaggttgcagtgagccgagatcacaccactgtactccagcctgggtgacagagcaagaccctgtctcaaaaaaaaaaaaaaaaaaaaagacaccaaaggatccttcaaccagatcattgtagtctagtttgttacagtaaagcttaggttttgaaaaaagtcaagatctcagcatttagcaacagaaaatatttgtgctgaaagtcccaagaattaggagttgctgttgttgacctttacagtaaaaatatttctgtcttcttcctcttttatgtatctgaaggtaacagaacgttggctggaatagaaaatatcttaagcctgttatctcttcaattaaaagtctctattaatatgacctggctgtgcagctatttgtaaatataactgtctggtcttttcctgcatagcataagctaataggtatgttacttagatggggatttactcaaagaaatgctagtctttattcttttctttatattttagatgagccctcacatattaagataacctctactgaatgcatactgtgggctagatgctttgtatgcattatgtcatttaatccttacaggaggataatgttatagccattgtataagtgtggggactaagagagctaagtaaattacccaaggccacacagctagtggtaagtgataaagctgggattcaaacccagatagcaggctttgagcctaagttcttaaccactatccccatgtggtataatgattacttgagtcaattccaatagcttcctaaagggagttaaactccacctagtgtaccaggattcgtcttgcccctttttatcccatattgtatatttgtaccatgtgcagctttcctacactcaccacacagcaccaccatgggtgtgcgtgtccgtctcccccacccctcgtggccattctcagtctgttctgtggtccagtggctctgcagtcaggtacaagccagtctactttctgaagaaatttagctaatgctgtaaatcctttgagtgaatgtgtttaaataagtctcccaatgtcaagcctgcataaatatatttctctatttgcattatgaggagaggatagcttttaaatttagaacgttaaaccagcaaattgttagtatattgctcctgggcctaaaggggcatttgatttagctggggtgggagttaggaagagagtcggacataatcatctacctgtggtgattacatagatttaagcgtgtcccagagacccaaccagacatgctgtaggagtgtattcattcaacagatacttaatttacaaagcgtttacccagggccccacgttcacgggcagcaggagatggcaggttaccctgatggacacagcccttctctgtgtccttctaatggagctcagacgagagtgattgtatatgtcgattttgtttgttgcattttccaatgtttgttaaaatttcaagcatagaagagttaaacgaatttcatagtgaataatcatatacccaccttctagattttaccattcccattttactgctcttgctttctctcatatttgcccattcctccatctcctgtgcctgtctgtatcatccactttcagaactcagacactgttattttaagggtactcatagtgtcacatgctaaaaattcttttttctttctcttttttttttttttttttttttgagacagagtctcactctgtcacccaggctggagtgtagtggtgtgaactcggctcactgcaacctccgccttccaggttcaagcgattctcctgcttcagcctcccaagtagctgggattataggctcctgccaccacacccggctttttgtatttttaatagagatggggtttcaccatgttggctaggctggtctcaaactcctgacctcaagtgatcctcctgcctcagcctcccaaaatgttgggattacaagtgtgaaccgctgcgcctggccaaaaatcattttttctgtagtcacatgctgaaaatcacttattctgtgatcgaccacaacaagttaattttttcaaaaagactcaatttagtctttttatacataaggcaaagtcttagtatacatagtcttagtatacataaggcaaatctgatttcctccttttggtgatcatgtcatgaaggttagaggtctgacaaagagtaagatatatttcatacaaatgatcaagaacatcacatttaaaatatttgagtccttgccactttatgcaaggcatttggagaatcttttgggggaaacattctccgggtaagacagagctgtccccgtgattcactggtgggactgaccatctgatttgcaaataatgaagaaagtgaaaggaggcggctggatgtcagccagcaggctgtgggaaggccagagcccttctgatggggtagggctttgctaaattgaggaagatgaggtgtgcagataagagtacagtatagtgtgaggaacagcagagatgtagaaaagtttggggaaatgtgtgaagtttgaagcttcagagtgaaggttagtggcaggtagggagaatggggaatgcagcacgaggcaaagttgagacctgtgctgaagaaactcctgattgagccacaggaagcttggaggtgactctaggggcagtgagtgctaatgaagggattttaattacccatgatggacagttaagagctttgcaaaataaggagtgggaagagaaagaggatgaagatgctgctcagtagaaaggaagaggagggaaaggtggaaggaaaggacagagaggcgccacaggatggaaacctcagcccaggagctgaataggttttaccgtgacgaggtgtctgtagttagggaactaccaaggggatttgggagttgagagtgaagaaggcagagatcgacgtatgggaaggatgggttcagagagaaagccagtgattggttacagttaagaggggaagggacctgccagggcagtaaaaggccatctgctgagggactgagtccgagggccgtgacggaagctgcaggaaagatctccagttggtagggttttgagaaatgtgttatcagcaggagttgggttgaaacaagataaagagagcgttccaggaaaaaaaaaaacaaaaccaaagagatagaaacaaacataaccacaaagatttcataacttaggtggagagctaagatcacatacataaccaactagtatgacagttactacacacctacaaattattgaccaagtgattttcaaagaacaattatttgtttttgccctaattaaatggattttaattttttgaggacacttgctatgaatagttcacctccaggtttttcctccatcttgatgaaaatccttcctggccagtttgctaagactgaactgtcttctggaaggccccagcgaacattcactctcctgttctagctcacagtcctgtgttcctttgtgatgtacctcacttagcttctggcagtcttctgaatccagaccactcacttctgaactctagcccgaggttacacagcggaagagaggtagagctgttaacggaattccaactcactaggctcttgactgtggccctccgagcccctccatttcacagccggtccttgatggaaaccaggctgaggctgctgtaccaatgatagtctgtccctagtgtcccaaactttggtactttttcaagttcttatttgaaaaaacttgtaacttagagtttggaggacacggaatatattgctaaataggagaataaaactacatttccttaaagaaaactgtagaaggaagggtttctcttagctgaagtgtgactgccaggccctcagcatgattgccttcatttccagcgtccactggggtcatctgagagtccatcccgaagccgaatgtcaccttgtaaagctgtgtgtttgagaagtcacagtcttgtggatgaaacatctttctcctgttagtatttgacatagagtaaaataacaagtaacttcagttttttccttagaggtatatagggcagtagaatgacatcatacttgcacatcaaaagcatgtagtctgtttttgatgcacctggcacgtgacagccagctgtctgccccatgtgtcggttggtgaagagtcaaaacagaccagccactagggtgtctgtcctacaacattaggggctatattagacagggtgggtaattttcttgcaattatatttttttctttttttaactagcaccatttgtgtgtgtgtgtgtgtgtgtgtgtataagactcaaataaaggggaagacttgctatttcatgttatgaaatagattcagtactgaaatattgtggagtgaaaggcatgaataattttaatcaattttctatgaattcagtaaacagtgattcaaatgaaaatcagtattttaactcaacattctaatgtgaaagttcagattgttttagtttaaatattaagctgatgctaaagtttatacataaaaataaacagctaagagatgttatgctaaagtattgatggtttttctatgaaagtgtggtactagtacaaatagatcactaagaaacaagagagtccagctatagacccaaatctgatatgtgatgaaggcggcatttcaaatcatgggggaaagatggattgttcatgaaatggtattagggtgaccgactgaggacaagatgttcagctggatccctgtatcatttctttttcttttcgcttttcttttctttttttttttttttttttttgagacagagtctctctgtgtcgcccagtctggagtgcagtggcgtgatctcagctcattgcaatctccgcctcctggattcaagcaattctcctgcctcagcctcccaagtagctgggattacaggcgcccaccactacacctgactaatttttgtatttttagtagagatggggtttcaccgtgttggccaggctgatctcaaactcctgacctcaggtgatcctcccgcctcggcctccgaaagtggtaggattataggcatgagccactgtgcccggcccctatattatttgttttacttaactcagttccagacagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttttaaaaagaagtatgaaagtccctttctatgtaagacaaaacccctcagcgtgacagttgtcagaatgtgggaatgttattgcattctctttcaaaagcaatttgacaaaatccatcggttctaaatacacagtctccttaagcctagcattttttcttctggaaatttcagagaccttttggattgcagttttcatctaaagaaccaccaggatggctgattaatagaaaggagaggtttataggcagtaacattttacagactgggaagagaccttctctggtgtgtgctgaagatgaagggacacattgggttttatgcctcacagggcctgtatcacactagagtcacatatatttaggagtttgggggcaaagcgatacgtatgtatgagaggagtcaagagcatgtgcagtaggtaaacatatgtaacatccatccttgttgactttgaggtgagattttagcattaaaatgaggtggaattgggctctttatgtgaaaaggtgaactgtgggacacagtttgtgcacagcctcagcgagctgctgaaactggctttaaggcctgcagttgcttgtcagaagaaaatgtttctaaggccagtcctctgcccagtcagagttgtcttggtctgggttgtaaatcagagttaggaggggtctgataggtcctgttcttagtgagtttagagccctagtaatttaaaaagttgctctattcccttaaccttaggatccatcttagttgataaagcagtgtctgttttggtctgtccgatcacatggtattatagtacccaaagactgaaaacaagataaatgaacatcagcatatactggtcaagttgtaggaaatatatacaatggaattttatggagacaatgtgaaagaatattgtgtccatatgtgctgatgtaccttgcagaatgttttatgctgttaagagaaaaaaaaaaagtaccgagcaaaaataatacaatttaggccaacttagtgtttaaaaacaaaaaggatctatctctgtccatgggatgtttgagtaagtatatacaaggaatttgttagtagcatgaaacaaaaattatagtaggccattgtttcagagttcctgcactaggccccagcagaccaggccaaaccagaatggagttccttgtgctagatgctccatagtcaaactgaaacttgaaggaagcagataggtcccaaaacaaactgattttttctcgagaacaggagatcccagtctacctgagttagcataataaggagtcccctctgctttaacccttacgaaaaagtaacctgaagtaaactgatgttaaccatcaactttttttctgttgttctatttccttattaacccatccttaaaaaccaagtgttctgttaatgcccagtgggagtgctcgttctagattgtaggaaggaggctgcccagattcatgaatctcaagtaaaggccaagtcgatctgtaactgaatttgttgtaattttgtgtcttttgacagtagtagttccttagaatgactagcatctcaggatgttaggcgtatttctcaaattgcatatacttttattgtttgaattttttttattatacatgtattccatttcaaattaaaaagcctacttaaaaatacaacagatcgctataaagcagttagaaataggtcctcatgttgagtgggaaaaagaaaacttgcaaagagatacatacagtatgacatcctttaggtcaattttaaaaatataaagcagttgtttgtgaatgtgtacatgtgcagctgaagtatgaaaacacacataggaatggatacaggttcagaaaagtagtggttacttctggagagaaagaaagagagggctgtagctgcatctaatagtttctttgttgctgttttcaaagttcctaagcaaatacggtaaaatgtgttcacatcagtaaaattagattgatgctaccttttgtgctttcctacatgtttggaaattaaaatattatgtatgtaaaattgttttgaatacatttctattaattgtttttagtactcctgttgtattcaattgtgtcagttcattattgaattgagtcatggtttccaaaagtcacaaaaattctccttctttttacccctctcaataggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccaggtgaggagaggggtgcaaggtcccaccctgcccgcccatggctgagtgggagagacagggaagaccgaactgtttttgctgttcccacactcagcacaacacagaacagttttgtgaccacagcatgggaagggaggattgccccacccaccaagcagctgtgcagcagacaccagctgagtgtcctacagtcatgacactgtctacctggagtcagatcaagggggttcccaccactcccaccttgggttcaattaatctgctggagcggctcacagaactcagggaaacactttacttactactgtcagtttattacaaagctcaatttacaggatgcaaataaagagccagatgaagagatgcatagggcgaggcatggggaagggacgcagagcttccatgcccccctgccccaggtgcccctacatgttcagcaccccagaatctcttttcctgtagctcaaggatttttacggcggtttcatcacataggcatgatcgattattgttattattattctttgagacagagttttgctctcgttgcccaggctggagtgcagtggcacaatctcggctcactgcaacctccgcctcccaggttcaagtgattctctcacctcagcctcctgagtagctggaattacaggagcccaccgcccaccgccacacccggctgattttttgtatttttattagaggcaaggtttcaccatgttggccaggctggtctcaaactcctgacctcaggtgatccacctgcctcagcctcccaaagtgctgggattacaggtgtgagccaccatgcctggccggcatgattgattattaactcaacctctggccccacttttctttccagagaatgggaggtggagctggaagttccaagcttctaatcctggcttggtccttctgttgaccagcccccatcccaccaggagtcacctcatttgaacaaaagatgctcctaccacccgggaaattccaagggttaggagatctgtgtcaggagccagggtcagagaccaaatatcagaacaaaagatacaccttgcacacctaacattcaggaagttacaagagttttaggagctctgtgccgggaactagggacgcagaccagatggctatttcttacctcacaataccactctgggtcattgagttgaaaatagattttattcaaaagaactgcttgcagttgcccttattcactagtagcaaacctggattcaattgtagatggtcattaactctaactttagttcagtcttacttatctgtgtgaagtcacagattcaaacgctgggttggtaaagtaaaagcagaatgggcggtggaggctgcagaaggctgagggcccctgctgtcgcccgtggatcactgcatttgcagggaagctgagcccacgttctgatctccacatcttcagagagatgagaagtcttggttatttgtcaccttctgattttaacatctcagcagctaacacgtttgttttaaaatcttgagccagaaacgtgtatgtggatgggatgtggctcatcctgctggtttaagacctctgcattcactgttttaacttcctgtttgactaggctatgaatagaaatactgaggcagaagagaaatgtgtggaatgggaaataatttgggaattaagggtatttatgtctgatctgaaattaaataagaaggtagtctcccattattttttaacaattcctgaaccctgtctcctctgtaagcacattgggccaagaattgaatgtctgttctaaacagcaaggacctcacttgtaagcccaaagcagggtgcaggtcccggctgaaggctggcagtcatagacaggagctgcctgtcagcaggaccaggggtgtgggctgggtagaagcgttgggagactcctggggtctggctctctggtcacttggcccacatccttctcatagtttgttcttctcccatttggcatttgtctctcggcttctccataatggcactcttaggacctgacactaaaggacactcaggccgttagagtaggggaggaaggagaaggaggagagcccacaggggaggaaggagaaggaggagagcccacaggggaggaaggagaaggaggagagcccacagcaccttatctgacacggggattattgtcagaatagtagctactgatgctgcttaattacttcttcactctcatctttttctcccacaccccaactcggtctttttaatgtccccctcgttgcccttctctcccctttattgttagtgttaaacagctgcttttcaaagttctgtcgtccctttcgtcctccccaagcctctagaattaaagggtattctgcttatttgtaaatgtataagactagatttatcagtgtctaggcctctagaagtcttttctactgtgtaccacttaacattcttacagtctgcatttatctgaagtgatgtggactgacagccctttaaaaaaattatctatattttcacgcctgtaatcccagcagtttgggaggccgaggcaggcggatcacaaggtcaggagatcaaggccatcctggctaacacggtgaaaccccatctctactaaaaatagaaaaaaaattagccgggtgtggtggcaggcgcctgtagtcccagctactcgggaagctgaggcaggagaatggcctgaacccaggaggcggagcttgcagggagccaagattgcgccactgcactccagcctggccaacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccgtctccctgcccctggtaaccacctttctactttctgcttctataagttttttagatttttttaaagacctgttaaaagttccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgttttgaatattaacaggttatcagatacatggctcgcaaatattttctcccagcctattgcgggatctggccagcagcccgcaatgcaacggggttctctttgtgttcccaggcggatcggcccgttgagaaataatagacacacacaagatagcgaaagctgggtccgggggggtcactgccttctggtcctgcagtgccaacaatgcactggatataccagcatttattattaagtttagtgagggcgggggtaggttagtgagggatttagggtcatttgattatgaggtgagatggtcacatggggatgaagtaattctttaacataacatctgtatgcagaagtacagtatacagagataagaatttacaatatagtgtatgcatcagtaatttctgacagagccttaaaacagaaacacagtctttccataacctatgattagcaagatattaatcagcagtaacagttgcagcaaaagctggttacaaacaatccgtagaaacaggacgtgaagctagacaacctgttagaccagaaattctcagaagggagtatgccttaaccctaaagaggcccagaagagccctggcaagatgagggcgtttatagccctatcttatccatatggacggtgcccccatgtgtctgtttataggctctttacaagggtcactttccattcccagagctatgaatatctgcttttctgggataggaatcttggtgatgtgaaacctccctgactgcacatccattcataggctctctgcagggggaagcacatcacatgctgttggctcattctggcagtcccacctggcactgtctttacacaatcctgcatgcaattttgtatttacaataatcaggagcatttcatcttttattccatagcaatagtttcagggggtctccctacaccagcccataggctaccttttcattttgattgtttcctttgctgttcagaagctttttagttccatgtagtcccgcctgttatttttgactttgttccctgtgcttttggtgtaatactcaaaaaaacatttgccaaggccagcgccaaggagcttttcccctgtgtttccttctaggagttgtgtggtttcaggtcttccatttaggtctgtaatctattttaagttgatttttgtgtgtggtgtaagacaaggtccagttttattcttttgcatgtagatacctggttttcccagcacgacttactaaagagactgccctttctccactgtgtcatctcggtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaagtaagtttaaaggggagccagggaaccagggccgtggtagaagtatacattaatacaaagtatataccctaccaagaggcagctggccttttccctttccagtgatctcctaagttttggatatgattcagttatttttatttggatcttaactgagaagcttacttaaaaaaaaaaaaggatttttgatttacaaggttaataagtgaaatatttattttatttaatgatttcccaaactgttttcattacttctagctttatcaatttatgacatattaaggtttcattgctaatgtcacaggaaagctaaaaagaataataataacaactctcttttaaatgttttactgttttgttaatcacttgccatgtgccaggcattgtgcagagaggtttgtatcattcgcatgtagccctcatatccctttgtggtacataaaacccctgttttactgcaggcaaactgatgcccagagagacgcatcgagtgttccagtcaggaagccaggccctcaggcgccaaagcacgtgtttcagctcctgtgcctaaaaacgtggtccggagctttgtgttagcttaggtttctcttagatttaaaacaaaaaaaaaagtgttgtgttttatttttttgttttgagacaggcgtctcgctctgtcacccaggctgaagtgcagtggtgcgatcttggttcactgcaaccccaacgtcccgggttcaagcaattctcgtgcctcagccacctgagtagctgggattacaaacatgtgccaccgcgcccagctaatttttgtatttttagtagagacgaggttttaccacgttggccaggctggtctcaagctcctggtctcaagtgatccgcccgcctctacctcccaaagtgctgggattacaggcttgagccaccacacctagccaaaaaaaaaaagtttttaacagtacttgtagataccctacttaacaggaaagcatgtgggcaccagtgaccactgtaggattctttggagagacctaaataaggctgtagtctatgccagtgtagcttgaaggagatatattagtaatttatgacttccatcagaattttcaagtactccttccagcagttatgtttagtttattttttgaaattactaatactttttcccaatattccaattccatgattcaaggcagatatcaaagaatgttaatctgtgtctggaaaaattaaaaacataacatttgacatatatttagacatcaagatctaggtctagatctagtttaataagtcctacaagttctccaaagtatatttaaatagcttcagtgattaaatgagttctcttttgactgcacacttttgctgcctcttacccagtttcttccattatatattttcctgctcaattgcatgcataataaagtgaataattctctgtcttgttagtcaactgtgtcttgtttcagagtcaaatttgaagttttcagtcatggtcagtagtgatgtgcatcattgtcagctgttctttaaatgtgaatataaagtatattgaaaattcatataaattagccccattttgaaaacgaaggaagcagagactgagaaaaatgagtggccacgttttcatggctgatgagtgaggttccagctcatgcctgggggtctctgactctggtttttggtgctctcctctgctccacacttgctctctgatttgcttataaccttaaggcaagtttcgtgacctgttggaacctcagtttcttcatctcgaaagcaaggaggttggctttaagaattctttctgctctaaaatatcattccaggctgaaaccacattaaagcagtcctaacttgaacctgtgcctctgaggcatctctgtctctctgtagtgctgtgaacgatttaacaccctgtgtatttgtatttaactaaactgtataaatgagtcacttaaacttaaaacaattataaaaaatgtttttaagtattaacactttttcagcaattaatccattttatatgacagctgtattctagtcatggaacataaatcttatactagaaaaagagatctgaaattaaatatacttgagcactataagaattcaccttgggccaggtgcagtgcctcatgtctgtaatcctagcactttgggaggccgaggcaggcagatcacgaggtcaggaattcgagaccagcctggccaacatggtgaaacctcaatctgtaccaaaaatataaaaaagtagctgggcgtggtggcacgcctgtaatcctagctacttggaaggctcaggcaggagaatcgcttgaacccgggagacggaggttgcagtgagccgagatggcaccactgcactccagcttgggcgacacagagactctgtctccaaaaaaaaaataaaaggcatcttgatgatgctgaaataattaatacattgctgtcctcaaatttttctgtggtccataacagtgcccaaaaattgaaatgcttacaagctggtcaaggagttgtcatgatatataatccccacagaagcgcacctgtagtcccagctacttgggagactgaggcaggataatcgcttgaaccaggaggtggaggttacagtgagccgagatcgcgccactgtactccagcctggcgacagagtgagactctgtctcaaaaaaataaataaaatagagtaattaataaataaaagtgttgcaggttagcctaattcattaagcattcagtatgctcccaaaactcctccaggtcctgaaaacacaaatgcttcctctaagtccctctggctgctgtaataggtaaatggatagcggcagtcaggtgtgatgaatagaatcacaaaatatgctcaaaatgcctaggaagactctacctgcggctgcagggagtacttccaaagagaggatgacttagttgccaatgactgaaatgtactgagtacatactaggttctttacataaatctttaattcccttatcaccttagaaggtaggtcattctggtctcattcttccacaaggagatttcagcccctaaggctacctaagtgttggagtcagaattcaaaccccatgccatccagctgcaggacacatctggtctcttgtgtaagctgcgttttaaaggaatgtctagagaaaggagactcaagggaagtcagctgagaatgcaggaaaagaagacacgggcccctgagagcatcacactggcctttggcttggcacatgaatgaaagtagaagcaatgcgactggaacttcgtagaaataagattccttttcccattgtagatattttgcttccttttcttctgtttactaaaagaaaaattctaaaacccaaattaatcttgtctttttcagtagccctttggatggctatgttctagctgtcctctaatttcagaaatgtcctttggatatagatgtgatttctggaagtagtcaagtttatttaagtttttgagtcttaagtgacctcccccccaccccctccccatagccaaatttattgattacactttgggtctctactaaagagacttgttttccgctgtcatgaactgcttctgaaggcaattccaaaagaaacaagcacatatgctgatgagcaggacagcccctttgggacagttgtggcctctggagagagcctgttgaaaggcaactttaatttggatgtagaaatgccagcatgtggctattgccccctgtggccaactcagattggcgtgctcactactcactgccccagggaactaggggggcgttttttcaggtctgcccttcactctggggtgaccgaatgtttcagacacagtcaagcaaatagagtgcccgtaaacatcacaccttctggagtcaaactgttctgtttaccagatcaagcttaattaaatgcctaattggccattgaacaatctgattacattaggtttcatttaccacagtttccagttctagtgcacccgaaagacaggacaaggttaaaactggtaagtaaatgtagacgagagttgtaaaattcttacaaggaaagtcttaagactgatgaacatttatattcatgattagatttcctggatttgcgaaacctggcacggaacagtatttgttggccaaacaactagcaaaacccaaagagaaaattcccatcattgtaagtttgtttatttttgtttgctttctttctgattaagctctttcttataccgtactttaaagctaagcgagttattcatcttttggaaagtatttttaaatatatttaatgccccacataactgataatatatgttagtgttgtaggagtactgaagataattaacacaaattaatgcctgtcattatattgtttattctttatctttcagacttttagtattgaacaaatatactattttgatcatttttttctaaagtgtcttgaagtgtattttacatagtttttctgccagccctatatgtttaactgatgaactcaattcaaatatttatgtttcttcccttgtaaagtacatgtatgttatcagaataaggtaccctttcagatatatgggtaatagtgtttttggtaatagtgttttttccagtaaaccagctgtcaaattgagataaggagctaccaaatggaagctgggagttaaagacatcattgagaatatctgtcttagaattacttggttattgcataatgtgacacaagcccttcggtttcattccacattttgattggtggtagattttctgtctaggtgatatttagttgtagattcccaaatgaaattctggaaaagagaactgtagctatcttctgatcctattgacttaaccctgtaacaattagattgggaacctgaagccttgagtgttctcatcctggactcaatcgaggatgaggaaacatctggtcttattctgtagtctttggaaacttgataaaattgcaggaatagtattagattctctaattacttgtgcctgcatgtttgaaaaactccaaatcctggaagcctccaagctgaagagctgtaaccaagagccctttttatgctttttccctcaaagcaaatttgggataattaacttctgagtagttatattaaagatttttttttcctgttttctctggacttaataaaaattgaacatgtaccattattcttttcatgacatttaaaactcctcaaaatcaagagcgcacagctctgcctcagttttgtttttttgtttgtttgtttgtttttaagacagagtctcactctgtcacccaggctggagtgcagtggtgtgatcttggctcactgcaacctctgcctcccgggttcaagcaattctcctgcctcagcctcccgagtagctgggattacaggcatgcaccaccacgcctagctaattttttttgtattttatagtagagacggggtttcaccatattggccaggctggtcttgaactcctgaccttgtgatccgcccacattggcctcccaaagtgctgggattacaggtatgagccactgcgcccggcctgcctcacattcttaaaggggactttgtcccaggtttgcagtggtggtacagagctaagggttccagcctttcattgaccggcaagttttaagtagaactgcacccatgcacccagtaggcaggtctgcctgtgtgggcgtctatacatggaagaagctgaggaaagccaccgcgtcttcaggaggcccagagaaagcagagactaactctttgctctaaaagtgcagtaaccttgcccactcatgaaacagagccccgtgaaattgggccttagccaagcacagttgctgctctcggcccactcactgagggaggtcccgaaagtcatctcctctgcagctttcagctagtttcttggatctgggctctccctgagggggttatagtaattgttctcagagattttagtctctttttaaactactcttatccttggagtaggtcaccttcctgacctaacagcctctgaactttaatatcccaatccgcttttcccatcttcctcttaaaaaaaaaaattaggactgggtatacctttttttcctttttatgtctgtctggccttgcctctctgaggtctcagccgaaacaaatctctcttccttcagcgcaatctgtgtgatttttctcattttctttttactttcttatggtactttttcaagtctgcaagaataaaacctgttccataaattatttcattctccttgaatctctgaatgaatctctgagtgaatctgcttcctgaatagtggtccttttacagtccatgtgtttgttttttcattctcttcttggattataactcaattatttttcattttcaagccaagaagatagataacattctcagtataataaggacttctattgctctgaaatgtgttttgataagagctactgtcctgcagtctgaacctctagaatctgtcattgtgatcaaagtttatgaaatgaatgaggcagaaccaacttgagactattggtgactcaggtagtgattccagaagcctgtacatgagctccagcatccaggttcctctgcagctgcccccatggccttggatgctgttttaaataagatgaaaaaaccaggtttgggacagcagacctattgtcacctagcagtgcctagaagaaatgatcctcaggctcaaaacttacacgaggtctctacacccccacatagaatttagctggtttcccttcctcacctcccaccacaactaaaaccccagtgagctagtgtaagcctcgcctgaatttgtgaacttttgccctagtcacagatagaagagaaggccagtgagaaaagaatggaggcctaccctcttcaggcaagccttgcccaggtggacgtgatacccgggggttggaagtgagccagcccactgtgcttaggcacatagcagtccacggaagaaaacagctagcctggttcttgcttttaagatgtagtacctccccctccccccaccttgccactagtagtaaaacaatgactatcaggctctggccaatctgattaatcgtttctatgagccagaacaatgctactcaaagtatggtccacagaccacttgcccatctgaaaactgcttgttcctgatccaccgtgagataggtacagtacatgagaatattttgaaaacttgaggacaatttggtattgttgaaaaatcaaaatgtgtaatgttatatttcaccaaactattagtctgtgatagattcgaaatttttaaaaactagtccttcatcacgtgtagcttgagacagctagactagaaagaaacattgtcttgtaaccagcactgtccttgggagagggaagctggtgtctcctctccatgggctgagctactcacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcattttccatcctgtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccttttctacaaaagaaatgtgtacatttaaaatatgtgaaaaatgacacctgaaaaaatagaaataattcaaatagcctaaaatggaaataaaaatgtatgacccacatgatgcaaacaggttatgcagatgagctgcattatttcattagatgagtgagcactggacagagaagccacagaactactaagtgttaatgaaggaagaagctgccaggttttctacttattttgattattaccctctcccttttcttgttttttaaaagtgccattttctatttattttgattattaccctctcccttctcttgttttttaagtgccacattccctcccctcccccagccccaagaatcttttggtaagtaacccatagtgttactagagcaccttgtaagtatgcagggcaccttgtaagtatgcaggtagaaagggtttgtttttgtgtcagggaattgtttttgtttttaatctccagcctagggtagactctgctactctatgtagtcactgagggactcagcatgtgtgtgttaaaataaaggttgtgtgccaggtgcagtggcatcccagcactttgggaggccgaggcgggcggatcacgaggtcaggagatcgagaccatccaggctaacacggtgtaaccctgtctctactaaaaaattagcccggtgtggtggtgtgcacctgtagtctcagctcctagggaggctgaggcaggagaatggcatgaacccgggaggcagaggttgcggtgagccgagattgcgccaccgcactccagcccaggcgacagagcgagactctgtctcaaataaataaataaataaataaataaataaatgttgtgaagaaacagacttaaaggttagacagagttttagtatattgctagaaaatgttcacatacatgaactagtgaaaatagaaaggagtggattgtgagaggaggtcttcaaaggtcagagccagagaggcctgtaagagatgtaaaagagacactgagatgctcacctgaacctagggagaagaaacatggagggctgaaggaagggttctttccccaaaggtcagggaagacaagaggcggtggaattctcactgcactcgcaagagtcgagagaaacagttcagggagggcctgcgacccttcacagccaggtggcagtgccagatggaaacatgtcagcactgccgtggagtttgtcccacgtgttcctggacacttcccgagtgcctctcatctgtcctcacagataggcattttcatcttcactttatagatgaggaaacggaaatccacagacattaaacaggttcccctctctattgctgaaaaaggaattcgaatctgatcccatagcttactctgtttctgttaagatgtggactgactaatctttccctagaattagtattcatacaatgagtaaattattctccttaaaacattactttatattttactttgttttatgtttatttttccctgaagtgttttgtggagatggaaacttttgttttaaaagaagttttgattttgatttttttggaacacatttcaaaaatttcaaattgtcatagcaaaattgaaaatggggctgcactactgggtagataaacacatctccccagtcccctgggtgacacttgagtggtccctcgtggtgctggggcggtggagtgacagccagatggccgtgggctgctgctgccttctgcccagaggcactgaccgaacccctgcttctaacccagttcagacactccctgtacctcaacccggttcagacactccctgtacctcctttttgtcatccttattgctttcaatcacagttttctcttaaaaaatacagatttctttccatgaaaacttcagttctgccatataaaattatagtctatttccttgaattttgtgctctcctttatcaacttggttagcacagtgtgtgctccacagtgtttaaatccatggcttaatggcctatttcaggcttgtaagaaattctcatatcttttagattttaatacattgtttattctgaatcagataattcagtgctcttttaaagcttcagagagtcacggttctccttccatactaagatttgtttaaaaaaaaataagttcggcatgcagccagggaggagaaagtcatagaaaagcaagaaagcagcagcccctcggtgtgaagaaagttgagctttgattcactaactgggatatgagccaaggaagccgaacagcacagaagggctctatttccccctcacttgtgtgcctcctgcctgggatgcccacagatcattattatgtaagaattcccctctcgctcaactactggagaaaagaaaaaggaatgcttagtaggtgatgctatgacattcctgtggactcgataattcatgaaaaaatgtacagttaacatttctttatttgtttagagatttttgttttttatggaaataatattgaatgaatatagttttattcctggtaccaaactgacatattcatatacttagtgaaaaccttagtaaggttcatggaaaacagggaaataaaagttcctctttttttctaattatttgcaacttggtctgaaaattctaccaagcataaaataacatctgaagtcataagcttagagataaaccagctatgtcagaaaaattttcacaagaataatttttgaataaaataaggatcactaaatttcaaccaatgataggataatgaactctgggtacaactcacctagccataatggggagttcatcgtatcccaggtccagactggctttccggccaggaggtgaattgtcttttttccaaggcacaaggctttgtttctgcttaatctactgctagtaaatgcaaagtttgcaatgctttagtacaatgatggtgtctagactcattgttctgttcaagtccactttttaggtaataaaagttttttgatatgtaggtgcataatactatctatctatattttatttatttatttatttatttatttttggagacggtctcactctgccacccagcctggagtgcagtggcacaatcatagctcactgcagccttgacctcttggactcaagtgatcctcccacgtagctgggattataggtgcacgccaccattgcctggcttatactcataatttctaaaggaaagttcaggtttcattttttaaattttatttttaaacttaggtacagtaaattcactctttttggtgtacagttctgagttttgacagctaccactgcagtcctgcaaccaccactacatttcatgatacagaacagctccgtcacctccccaggttccctcgtgctgcccatccccctggtcctaaccatggcaacagctgatgtgttctttgtgttcataattctgcgttttctaggatgtcattataaatggaagcatgcagtgtatagtctttcgagtctgactgctttcatttagcataacacatttgcaattcaatcattttgttgtgtcaatagtttgttcttttcgtggccaatagtattccagtgtttagatataccatagcttgtttatccattcactcattgaaagacatttgggtttccagcttttggcaattatgaataaagctgccgtaaacatttgcatacaggtttttgtatgaatgtaagttttcattcctcttgggtaaataagagtaaaatgactgggtcatttggcaagtatatatttaatgtttaagaaattgcccaactgtttttcaaagaagctataccattttggaatcctcaccagcaatatatgagagtatcagtagtagttccacatccctacctgcacttgatagtgtcagtttttcctcattttaaccagtccgataggtatgcagtggtatctcagcatggttttgatttgcatttcctgatggcgagtggggttgagcatctcttcatgtgcttatttcccatctgtagatctttggtgctgaagcttctgttcagctcttgtgctcattttttatcagtctgttttcttattgttgaatcctgagatttttaaaatatatatatgtattttctagaaacaagttctttgttagataagtgatttgcaaataacttgtcgcagctgtggcttggcttgtcattttctttttctttttttttttttttttttttttggagacagggtctcactgtcgtcgcccaggctggagtgcagtggcaccatctcagctcactacaaccttgacctcccgggctcaagcagtcttccagcctcagcctcctgagtagctgggactacaggctctcatcaacacttcttgttaattttttgtatttttggtagagacaggatttcaccctgttgcctaggctggtctcgaagtcctgagctcaagcggtccacccacttcggcctcccaaagtgttgggattagaggcatgagctaccacactagccttgttactttcttaacagtgtcttttgcataacaaaggcttttaattttaatgaagttcactatatcagttttttctttcatggactgtgcttgaggtgtcatggctaagagcagttcacaacattttcttctaaaggttttaggcttttcgtttagatctttgatgcattttgaggttatttttgtataaggtgtgcagtgtggtagaagtagtgcatttttttttcacatcgggatatccagtgggtctcacaccatcttttggaaagacagatctgttttccatttattagaaacatgtttgtaagagaaaaaaaatcagttgattgtatttgttggtttatttctggattctattctgctccattgatttatgtgtccatccttttcgctagtcctacactgtcttgacttgtgtagctttatggtaagtctttaaatcaagtagcgtgaatcctccaacttggttcctttacaaaattgttttggctattctttttcttttgcctttcctagtaaatttaaatgtcagtttgtagatatttataatcatgctggaatttttattgaaaccgcattgattctgtagatcaattttcacatcttgatatctcatcttttaatccatatataaaaatatatcgtatttgattttcattagggttttgtagtcttcaacatacagattctgcatatattttgttagatttatgtgtaagaatttcaggccaggcgcggtggctcatgcctgtaatctcagcactttggtaggccaaggtgggtggatcacctgaggtcaggagtttgaaaccaacctggccaacatggcaaaaccccatctctactaaaaaaaaaaaaaaaaaatatatatatatatatacacacacacacacaaaaattagccaggcgtggtggcacacacctgtagtcccagctactcaggaggctgagtcaggagagtcacttgaatccaggaggcggaggttgccgtgagccaagattgcaccactgcactccagtctgggcgacagagttagactctgtcaaaaaaaaaaaaaagatttatatgtaagaatttcattggagagttgtattgtaaatggtactgttttttaaatttccattttctagttatgtattgcatatagagatcgcttgatttttgtatatccaccttttatctgtggccttgctaaactcactcaatagttccaggagcttttttgtgggtatggattctttggtttttttgtcttttcttttttttttttgtttgagacggagtctcgctctgtcgcccaggctggagtgcagtggcgctatctcggcttactgcaagctccacctcctgggttcacaccattttcgtgcctcagcctcccgagtagctgggactacaggcacccgccaccacgccctgctaattttttatatttttagtagagatggggtttcactgtgttagccaggatggtctcgatctcctgacctcatgattcacccgcctcggcctcccaaagtgctgggattacaggcgtgagccaccgtgcccggccctcttttcttttttaatgtagacaatcatgtcagcttggaatagagagttttatttcatcttttccaatccatgggccttctacttctgtttctgccttattgcacttgctaggacttcctgtatgctcttgagtagaaatagtgagagcaatcatctttggcttattcctgatcttagggacaaagcattcagtctttcaccattaactatgatgttagctgtaggttttttgttagatgtgcttttatcaagttaaggaatttctcttctatttctaggttgttgaaagtttttgttcatgaatagatgctggattttgtcccatgtattttgtgtactcatcgagtgattgtatggcttttcttctgctattaatacagcaaatcacactgatcagctttccattgctgaaccagccttacatgcctggaataaacctcactcgatggtgatagattattcttatatattgctggattaaatttgctaataatatctggttgaggatttggttcacgatggttattggtctatagttttcttgtaatttgtttggttttagtatcagggcaatgctagtctcataggatgagtttggaactattccctccttgtttatattctggaagagattatatagaattgatactgttctataagtgtttgatagaactcaccactgaaatcatctggacctggagtgttctttgtggggaggctttaactatgaatttaatttccttcatagctataggactattcaggctgagctttggtagcttgggtctttaagggagtcgatttatttcatagaagttgttaggtatagttttagagttgctcatagtatttctttgtacctttaaagatgttaggtctactccttcatttctgattttgatcattgtcacctctctttttttctttggttttatgtatttttatttttctcttttctattatattgtttctgctcttttatcatttctatcgcttggtttgggtttgatttattctttttctagtttcttaaatatagaaacttagattattgttttgagatatttccgctatcacaggcattaaatgctaaaaactttcctctaagcatgcttttgctgcattctataaagtctaccttattgagttttcatgttcattcaggtcaaaacattttctaatttttctcataagttcttatttgatccatgggttatttagaaatatacctatatctcagtatctatgggaattggttccagaacctcccacagataccaaaatccattgatgctcaagtccctgatataaaatggtatagtatttgcatataacctatgcacattctcccgtatattttaaatcatctctagattaattataatacctaatacaatgtaaatgctatgtaaatcattgttatactgtattgttttgagaataataacaaggaaaaaagtccatacatattcattacagaaaaaaattttttccctcaaatatttgcaatctaaggttggttgaatccatgggtgcagagaccgtggatacagagaaccaactctatgtttaatttccaactatctggccatttcctgaatttttttcttttgacctccagttttattatgttcagagaacatactttgcatgatttttagtcctcttacatttattgagacttattttatggcctagcatatggtctgtcatagggaatattccatgtgtgcttcaaaagaatatgtgtctgtagcagctgggtggagtgtttcattcatgtcagttaggctgggttgatagtgttattcaggtttctatatccttgccaattttctttctagttctatcaattattgagtatcgggtattgaaatttaacattatgattagtggactatctctccttttaattctgtcactttgttttatgtattttgagtctctcttgttaggtagacatacagtttgtaattttaatatcttcctgatgtagtgacctcttatatcatgaggtgtcccccattgtctctagtaagatttcctgtgttaaagtgtacttgtctaatattaatatagccactccatttctgttatggttactgtttgtatggtatatcttttcccatccgtttactttcagtatatgtgtgcctttgaaatcaagctgtttctcttataggcaagatagttggatcttacttttttatcaagtctgacaatctctgcttttgattggggtttttaggccatttgtatttaatataattattgacatggttagattcacatttgccattttgttatttgttttctgtgtttgcttctttttcctcctttactgccttttctttgtgttaaatattttacggtgtattgttttaattcctctcattgtttaagctaaatttttgaagttattttcatagtggttgccctaagggatataatatgcatcttttttaacatcacagtgcactttagattaatattaattccagtaaaataaagaaatttttctcctatatagctttattcccttccctcatttatgccattatttttatatatattacatctgtatgttatgaatccaacaatacattgtggtaattactgctttctacagtcttttgtcttttaaagacactaaggaaacaaattagaaaaaaatatatctatagaatcttttacattaatccttatatttccggtgctgcttatttgtctctgcagattcaagtcaccatctttagtaatttctttttagcctgaaggacttcctttaatacttcttataatgcaggtctgttatcagtgaattatctcattatttatctgggtatgtctttatttttagaggatagtcgtaccgatctggctccattgtgtcagaaagcaagtcagctgttaatgctgtttatctcacgtgcccactctactatgcatgatcagtcattcagatattttttgtctcactctctcttcttcctctgggattctcattacaagtgtttggtgtgcttgatgtattctaatattttacgtttaagttttttttctctgtgttcttcatgttagttaacttctgttgatctatcttcaaattcactaggtgttttttttcttctgctaccttaaatcttatgttgagccttatctgcagtgaattttttatttcaattactatactttcaactccagaatttccatgtgattcttttttggtaacttctctctcctttttgaaactctgtgtgttgattctctgtcatatttttctttaattttttaggcttcctttagttctttgaaaatccttatagaatctgctttatctgccacattgtttttttctgccaaattcaacatctgcggacactcagagatagtgtctattgactgtttgtttttttctcagtatggttcatatcttgctatttctttgcgtatctcttaattttttgttgaaaactggacatttttgagaatatattttagcaactccagattctgagtttacctctctgaaggttgttgtttctgctttttatttgttaagtaacttgcctaagattaaatctctgaagtctgtctccctggaagttcagttattgctgtttgtttgtttgtttgtttgtttgttttatatttgtcttcctagagtttgctcctgtgtctgtggattggtagtaagcctttgattgactgacagaggttgtacccaaccacctcaggccagtaagttggggctcctgtcctctgtcaatgtaactgtaactcgatgtaactcattcaaagctcaggtcatttttaagttgccctggcttttactttctaccagacccttttgtgtctcctttacttgtatgtacagcctcagagttgaccaggattgtgtgcctggcttggaccctctctggtctccaatgtgtatgcatacagcctcagcctggaatatgcatggttcaaccttggctatcagggctgttgtcccttcctgttcatctgtctctgagattgtcactgccactgacaccaccattgaacatggcatctcccatcactccaagcgagccttctaccctcacggagaagctgcagctgcccatcttcacagcctgtccaccctagtggtaccaccatgtcgaacacgtggggtgggtggcacacaggcagcagatgcgggggagacaggagcagcctcccaccaccacagatttccaccatcgtcgcctgaagttcagttcttcaagcataaacacttctcaggtggccattcgccttttgttgatttctagagcactcatttggttgtttttattactgttgtctagctttatagttgcttttgaggggtagggttagctgatctctccaggccatagctggaacttctaccactagaaggctttcaactaatagtagtttttgtttgtaggtttataaacattcttagtgttcacttgatgtttgttatgctattcttgtcaagctgactttctacttttaaaacagaaaggaccactcattaaactgttttagtagagtcacaagttccagaatagcaacttccattattgcattagtggaaaaattcctttggtatttcagtttaagtaatttaaaatacctggaggaaaaaagctatagccttgggttactcttcataatgctaaatttaaacttgtatagatgtaatttatattgcatttggacacattttgataatatggaaataccatgtcgtttgtaagaatgacattaaattccactcatcactcctttcttgcttataggacttcatgtggccacacagaaactggcctgttagcttataggaaagagacaggttttcatgttgagataagatttaatttttttttagtactttaaggatacttgaagaaagtagcaccttgaggttgtcattattcttgtcacaatatgtgaatatgttaaattggaattatgttcttaaaaactgaagtctgttgcatcttacctgtgggcctttgagcattcgttgtgttgcttgttttttagattagttaaaaatctccatggtttaccttttgctaaatagctttctacccaatagccagtagacatagaaatggtttttcagttacagtatggtaacagtcattcattttagacaaagttgtatgtcattcttggtgtgtcgcttgcaggccgctttgaagaggaatttatcaaaatgcgcatggagagacttcaggcctggatgaccaggatgtgtcgccatccagtaatctcagaaagtgaagttttccagcagttcctaaatttccgagatgagaaggtaggacattgtgttaatatggcatcagagaatattgagagttgtctcattcacaccaaacttatttctgaaaggagttaaaattatgttggttagttatttctcacttcctccagtgacagtgaggggacagaaacctaaatccccaccataggaaatttgtcatgatgtgtgaagaactgcctgccagaagggcttccccctacactgggagtgggttggctcaagatgggcaggggcagggtgagggatgtaatagggtcagcagtttttccctagatgtttttaaaaataggaggataggccccaaactctgaaggtattatcagcatgaagtgaggggagtggagtgactgattttcccgatcacgttgcccttacaatgtaacagcatgatggcaggaaagggagaggcagacatgagccgctcttctcagagccaggccattttcatcactgtaatggtgagtccagagtcagtgctggcctctctctctgcctgcccctgtggcctgtagtctgccagtggtcatctgttcttcattaaaatcaaggaaacgttggctgcctgacatctcaaaagtgtctgctttggaaatagttttctctctcagtaagcatttactgtactccttattgtatcattttattctctaaagatgtttcctccacaatttctctcaacaaatactgcatctctcagcaccctaaagaataaaagcaggagttggcccagaagccacagcagatgctaaatacattatcagcctgggaaataaattatgaagctatttttgtctttaatgaaataatagaatatcatataccctcttggaacttcgagaggtttacttgctaaacttctttgtagtaattttcacttgttgaagtgaacacatagtaagtcttaaatattagggctctatcggtgtatgtttacaggtgtatgcatacacttaacatacatatttgggccttattttcagttattgactatttctagaattgaccagctcatgtgatatgttatatgtcaccagattgggaattagacaacatggagatgcttcaccatgtctttgtgaatttgtgtatatcacaggtctcctcaccatgtcttatgaatttgtatatgtttatggtgagatagggtactcagtcacactgtgtgtcatgtagctatatagtagtgaaactaagttctttgaattcagtaaatatttgggttactttgtagttacagaaactacagggaaccacctccaagtttgttgccttcctggttcccacaagactttaacaagagcttatttgatagattttccaaggatttgatttagaaagcatttctgaaggtcatgttttctgcatggtggagttaataaatcctagacatcagttgtgttggtttttttaaatgccaccttcaaagagggatcaacgtgtcataaaagtggtataagagaaaaaagaaagaacttggagtcagggcccttgagttctggtcttagtgccacttctagctgcctctgtggtcttagtgaaggtatttaatccctttgggccagaatttcctcacttgctaaatgacactgtagaactacatagaaactatgattctgtggtaagtagcagctcgtgtaaataaatggtagacacagaaacccccaaagaatctgcagagacattattagaaataagtggttagtaaggtagctggatacaagacattgcatatttatcagcaaaaacagaaattgaaaatctaaaaaaaaaataacctgtcatttacagtaacatcaaaagtatcaaatatccaggaataaatacaagaaaatgtacaaaagatctacatagaaaactatgaaacattattgagaaaaataatagaagacctaaataaattttctaatactgcgtctcatggactggaaacaataaagatgtcatatgtagaaaatcaaaatgccaagcatagccaggatgctcttggaaaataatgaaataggaggaggactttattgcgtatcagaactcattgtgaagctaaaaaagtttaaaagcatggcattggcataaggctagacaaaccaaccagtagagcagagtagacacttgatctatgacaaagatggcactgggcgtagtaggcaaaggatagtcttttcagtaattggtgctgggtcagttggatggcaaaatgcagggaaatgaaatgtgctcgctacctcactacaatctgcagttgattttattaaggttgttattgatattgttatgtttttaaaacatgtcccaggctgggtgtggcggatcacttgaggtcaagagttcgagaccagccaggccaatatggcgaaaccctgtctctactaaaaatacaaaaattcgccaggtgtggtggcacacacctgtaatcccagctacttgggaggctgaagcaggagaatcgttggaacccgggggtaaaggttgcagtgagccaagatcatgccactgcactccagcctgggcaacagagcaaaactctgtctcaaatatatataaatatatatatgtatgtattatatttcaaattagctttaaagtaagaaaaaaaaaatcccagaggtaaaatggaggagaatacctatgaaacaagattggcacctcccggggagcagtggtgcctgggcagcttttcccttggccacatgtgctgaaggtggagctgtgggtctcctgtggagtcacagcagacaggcacttggaaagtttctttcactctgagttttggttgaaaggaaagcacccaaaactatagccaaaggagtcattatacttccagaaaaatctcaaaagtattgcaagcaacagtagtagctattggatcagaccttaaaggtgggggtggaaagatttaaccagttagctcagtgaaagttaaagttttcccagaatatggaggcagcaaagtagttctagacaaaggtcatttcttatttagaggtggtgccattcttggaaagtgtgtaagccgaagtaaatccctactgaaatggcatcacatgccaccacagttccgaaagccttcatcatgtaaatgacttccgtatctcttttactaaactaatgatatttttaaaaagattggcaaaagtgttggtaattatcgaagctgaacctggggggtttattatacttttcttcttttgtatatgtttgaaagttttcattgtatatggtcttcttgaaaatgaattccatgtggctcgcagatttaaatgtgaaaagcaacatagtaatgcttacagaagataacgtggaacatcctcctatcctagagagcagggaagaatttctgaaatatgacatgaaaaagactatgcaggaagatgtggataaattagactacattagaacttcttttttcagccatgacaagcgaaaaacaagctactgagtagaagatacttgcaacatatataagcaatgaagggctagattttagaatataggaaaacatcagtaagcccagtggaaaaataggagatgtgatcatgtacttcataaaataaggtatctgaatcaacaacagatgtgtagaaaagtacctaatctcattagcaatcaataaatacacattaaaaccacaataagatgccactacacacgtgccagaatggctaaaactgaccataccaagtgtcatcttggtgaggtgagatgctgctgggattcataacgtgttgggggaaaatggtaagactaatttggaaaagtttggcatttactgaagttgaaccctctcatatgacctggcatttccactcctggatatgtactgaatagaaatgcaggcacacagacaccaggagacatctacataacagcttcattcataacttgataagggtggctaccagtagtagaatagataaataaattggggattactcataaagtagaatattatacagcaatgaaatgaatgaactgtagttctacacaagattttgactgtagttcctaagcaagattgagcaaaagaagccaggcaccaaagaacgcatttatagggctctttgctagcttgaaaaactagcaggacagggtagcatgcatgcgtaggtggtaaaactctaaacaaagtgtctgagtccatttgtgctgctgtaacaaaatacctgagactggataatttatatacaacagaaatttatttctcacagttacggaggctggaagtcgaagatcaaggcaccagcatttgctgtctggtgagggctgcatcctccaaaggagagaaatgctgagtccccacatggtggaaggtggaagagcaaaaagggacaaaccccctccatcaagcccttttatcaggatgctaatctcattcacaaggggagaagctctcatgacctaatcacttcttaaaggccccacctcttaatattatcacattggctattaagtttcaaaacatgaattttggagggaacacattcaaaccatagcagaaaagcaaagaaatgaaaaccataagagagagattaccggttacctttgtggggaagggaagaggtagcagtgtttggggaaaggacaatgcgggggcttttggaatgggagctctttgctccttcctggcctagttggtcgttaggcaagtattcactttgtgacaattcattgcactggatatttttgatttgggtactctgtgtgtgtatatcttaatatttttaaaaaaatagctcataatactggtttctgtcttatattttagaaaagcatttacctttttagaaaacagataacctaaatatttgaggcactaggtcagaatgcatagggtgggccgagcacagtggcttatgcctggaatcccagaacttttggaggctgaggtgggcagattgcttgagcacaggagttcaagaccagcctggctaacacagtgaaaccccatctctacaaaaaatacaaaaattagccaggcatggtggcatgcgcctaaagtcccagctacttgggggctgaggtgggaagattgcttgaacctggaagctcaaggatacagtgagctgagatcatgccactgtactccagcctagaaggcaaagtgagactctgtctcaaaaaaaaaaaaaaaaaaaaaaaagtatagggtgtttctgtttgctgtttttatataggtagccattggaaagagaacatggctgaattggttcattctttaaagatttggtcccattaggaccattctgtggaatgacactgttcatgccctgagattacattcggagtataaaggtatttagtccatggtgcagagggagatagagtgggagctgcttcctgaaaattagaaagataaaggtgataaatgagctggtcctgtttgggaattttgaagaccagtttgactgtgctctccacttgaaccttacaacattctcatttacaggaatggaaaactggaaagaggaaggccgagagagatgagctggcgggagtcatgatattttccaccatggaaccagaggcacctgacttggacttagtagaaatgtgagagacgctgccaggttttctttcttctcaatccgcaccctcctcctttggccatcaggcttcagccagtgtagccgcagccgaaactcaaatcagactagacttttatgaaatgagtgggatttgtagtccaatgacaagggaaacatcatttgtacatagaagtactgtctttctaaccgcaacatcaaattacaatctttctttcaccttgaagccagtgatttcatagttgacacggtgctgagtagctgtttccaatagtgtgatgaaaccaagcggcatggagccacctaaaacccactcaatattcagacagcaaatctctttgaacattgccttgaggaagcagtctctaacctgctttttctgtatgcttttttaatctgttgattgattttaatcatgtagttttttaaatgcagggtcagttgaaactttggagtagttccttttctcttacggacttaaaagaaatttgcgtggtttttaattttaagcttttttttttttttttttttttttttgagacggagtcttgctctgtcacccaggctggagtgcagtggcacgatctccgctcactgcaagctccgcctcccaggttcacgccattctcctgcctcagcctctcgagtagctgggactacataattttaagctttgttatcataaaattattgcgtatgtgttaccaaaagtatagacaagtaacacacacacacacacacacacataacccttcaaccacgcagagagaaaatcagtgttaatatgttagtgtttagtctcccaaatcctcctctgtacgtatgtaattataggaaagattgtttaaacaaaaatgacctcacactagacattttgttttataatctgcttttttcatctaacagtatattgtgatcttttcaggttggtaaatacacttttgacatccttagaaagaactggtatctttaggatcacttaggtgattgtgtatccaggttattgtctccgtttcatggagtacttggaatgaatggccagctagcattagcaacccctgttattcttttatagatttgatggtccccccagtgattggaattttcctaaataagatattcaagaaattattattttatttactttagaataattttaaaattcacaaagaattgtataggcagaaaggaagcgaagttaaaatataaatcagcgctttttaagtagttctttaaatgtctgcatcaagcctgtatttaaggctaacttagtgaaaggggagttgttatcatgcaagaaaacaagtgtctgtggttatatttggcccgagtatccccacagcagtgctgtttctcctgcttatgtgactgacggccgccttcacccacagagagcagaagtgcgaggctgtggggaagttcaccaaggccatggatgacggcgtgaaggagctgctgacggtggggcaggagcactggaagcgctgcacgggccgtaagtccactcctcacagtgcactgggctcgtagggggtgatgcaggctcagttttatgtcccttatcatagaggggaacctgctgcctcgaacagaagtgtatttggtggacggcagtaatgtccctcctgtgattctgcttgatctcacttcacctgagttaaaccacagaaaactgaccagcaaagccaggttaagaaatctcatagggaacaccacgttcacttaattagttccagtaatttggggctttataatctttggaaaattaatcatttttgcatgttttcagagtgcttgtagttattcttagtctcatgattttattttttaatcttcatccatttggtaagatgttgtgtatttgactaaaaccatagtgtttagaaaaaccaatatagttagtagtagaaaatatgtcacagcagaagcactgccgaggggagagtgtcgctgtcagtcacggctttctgaccactctgctgtgtccctaagaacttcctgcctccctccttctcctttgtttgtaggctttcattctgctgaaggtttttcctgtatttcctagaactgtgcagctctgtcaccacacatgtggcccaggatagaaaaatagtcccgtatccagctgtagggctaatgccacgggctgctgccctgttacacccacaggctcagaggctgcagagtgacttgtcaggccctgaaatgctgcgactgcactgctgtcccatgcgcagatgcctttaactcccttagagtcctaggacttctctcctttatatctggtctgcccttattgctgtgtcttaacctctagagaacagggccttctaatctatcactaagaattttctggccttcacctcataacaccatacaggaatattggttgtattcagttaaaaaaaatgttttatattttgaattatgagtaacatatacctacttttctatcagcctttgatgctcagcataggaaagggatctgttcttgtaatgatttttttaaaggtgatatttttacactaaaaaaagaaaacaatcagaatttgaaatccaataataattttaaagagaggaaactaaatatggagtgacttgtagatgaattaataagatagcacagcaaagacaatgtcagtattactattcaatccagatctgaaaatccaaagccttacatcaggagtcagtaaaccatggtccgagcaccatatttggcttgccacttattttgtaaataaagttttattggaacacacccatgcccatttatttgtatattgtctttggctacatttgtgtcataatggtagagttgagtagtttcaacagaaacttgtggctccataaagcctaaaacgtttactatctggcactttgcagaggaagtttgccaggccctgccttacctcaaccattggccaataactacctctgcctcttcctctactagcagtaataccagtaccagtggtgctttaccatccacatattatcttataccaacaaaacaacttgtagcataccagctgttcgtgcttgaggggcagacatcaggaataacagttgtttctttcccatggcaaagaaatatgatgctgtatcctaaatatatagaattagccctgagaaaataatgtatacaaatgcagcatctagaaaacaaaacctgtgtcaagactttagtcatagaggatgactcaggaacaaaaagcaaagttgacgttgttctctaaagcagaggcccccaatccccaggccatggactggtacatggaccattaccgcacagcaggaggcaagtgaagcttcatctctatctacaggtgctccccatcactcacattaccgcctgagctccgcctcctgtcagatcagcggtggcattagattctcatagaaatttgcaccctattaagagccacgcatacaagcttgtgagcccttatgagaatctaatgcctgataatctgaggtggaacagtttcatccccaaaccatccccccgacccactgtctatctgtggaaaaattgtcttccatgaaaccagtccctggtgccagaaaggttggggaccgttgctctaaagtataaatgaaagaattcagtttttaaaggcaatgaattaattttgactgtaaactcttgcaagaccatcataacacatcatttaaatctgtatgttctttgaaagccatttttcctgagtgtaaattttacaattgcattttttaaggatatcataaaaatttgggattatgatatctttttaaaaattaaatcccttatgtctaatgtctgatcaactccatgtcctgtgtaattcacaaggctaaatgtagaaagtagggaatactggcctcaggccgctcttttgtggggtggggaaagggattgactcaggcatatctcctcctgtttctcaaagtagttctttaaaattcctaatgtgtagaatgaaaactctagcacacactctgcatggtgaaccacatgccaggtgcctttaggtagagaggcaaaactgaggtaccacaggggtacaatttattaaaattaactgagctcgtgtaatttggattcatgtttcctgataactgcagcttatagaccttacctcaaatgtctctggcctaaatattttttaaagaaacattaaaagttttctttttctcctttaatactgcagtgagtctttaaatgcaaataatggtttcttttgaaaggcaaacagatgctccatttaaggggactccatacagatgcaaagaaagtagcttaaggtgcagagactcttgggaagttctccaaagtgatcctggaatcttagcaccttaaaaagaaaccttaggggtcatttattgaaatcatctcttcatgcagatgagaaaactcagacccctcttccctggtcatgcgaagtctgactgttgtatttttctccataccttgttgctttcagtctttggtggttatggtttgcaaatggtcatttatgcacctgtaacagagtgggaaaggctacgtatttggaatcacaagtccatgtccagcatttattagccatgtgaccttgggcaagtcagttatctgagccttattttcctaatcctcagcatgaggatggtgtctctgcatctggtagaggggctatcatgatgatcaagcgcggtgtcgctagaagtactttgtaagctagaaatcatctaaaggagcttccatttcacttacatctcatttggtgaatgagaatgtaggagtgattgtcagtaataatagcatccaccattagttgaacagtcaattaaaataatcgaaagaaatcaattgaaaaaacaatcacttttgcaacagtattttgtgaaggaatatatagactattttgaatcacttcaaaagttactgtaatcacttttaggaaatagtttaatcccatttcagtttgctcagaagactaatcgtttattcctttttgtctttcagcattacccaaggaatatcagaagataggaaaggccttgcagagtttggccacagtgttcagttccagtggctatcaaggtgcgtctttcttcattcatccagtgggcctttagagccttatgtagacctgtcacctgcttaggatcctgcagacgctaactccctcctcagtgaagcaccctggttgtgggtgtgtaaattggctaggctgccgcactaaggacttttgcaccctcatcctaggacttttgagaaaagccaaaggtggttataatttgtattttcttgctagctcgtttgcctttttttgctctctggtgtagcgcttttgtttcaatgccatcagtttcatttctctgccaagtcttcctgtgacagaggccagatttggctgggcacagtggctcacacctataattccaacactttgggaggctgaggtgggcaaatcacttgagtccaggagtttgagaccagcctgggcaacatggtgagacccccatctctacaaaaaaataaaaaattagccacgtgtggtggtgcatacaggtagttgcaactatttgggaggctgaggtgggaggatcacttaagcccgggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaaagcatttgtcagctaggtggcacctattaaatctgttatctcctgtcacttatagaagtggtagaattggtacaggtgttgatcctgatactcaaggcagacagtgctttggatgtcggtttctgaatattttaataataaactaataagaagtttctcaccaaaatgtaagatttagggctcccacatggcaatagttctcattgccctggccttaccatgtcttacagttgacacttttagaccagaagcgggctttgaggtctagactgggaactcaaggccagaacagagaagcatcttggcccaggtaacaagtgggtgatggaagagctgagagcaagccacgcccattgcttagggaggaggcagaggtcttggagcccttttagcatggtggctctgtgatgtctcaacagggtgagaagatttgtcctagagatgctggaattttggccatcatgatggcccggctccacaggcatccatgggttccccactgggagctgcttcgtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgttgactggcttttctcccattacaaaggacagtgaaggtcagcagtgtggagtactgtgtccatcacatccacttgctcagatgtgttggcgtcttagagcagtgctatactatgcgatcttgcaataatgtaaatgggtttgattcctggaaatattgtgattatagtaaaaataacttccagtgctcctttacaagttcatgtactaacttgaaataatacagactattagcatggcccctgcacaaaaccatgaaacattgcatattcttatggatgagcatatggaaatataagcaataaaaattcttaaatgattatagggaaggagagagagagatggaaggtaaactgattatatcttgttttgtacagttgactttggaataatgtaaatgctttacataattattagaaaacaaatttaaatcaaaatggaaaaaaaatttctaatcaaaagcaaaataaaacaaatgatacatcaaaatgaaggcatagcacacagaggaattgtttcaaaacaccttaaaatggcattttatatgcccccaggagcgggtgcctcaaggtcagaaagactataagaatgttagttgttttcactaaacatgtagtcaatatcatgttggtattgttattctaaaacttctaaaactatttacatattgtaggataaagcaaatacgtaattatgttactgttgttagcaattaagatttttaaaataaaaagttttaaaataaatgaagaaaacccctaaagtcataaatttgctttggaaacagtgtgaactcattacatgatttccttcttaaaaaaaaatacagtttgcctttctgttaaagctctagaaacagttacccaatccagtagcaagaagcattccctggcaccaatcgtaaggtccacgtcccaccacagtgaaccagggttcctatcaaaagacttagataccaattggaagagcctaccactggccaaagaaaagaaaatgtgagcattagtgaaaataataattaatgtggaatgaagcatatcaaatatttttaaatccagaattataaagatgctttttaagaaattaatctcagttacttttggagaatggtggtggattaactcattattttgaaaactataaagagaaagaattaagcacttaacctgcttttcctgttcaaactctacctctgggtaaccggaatattgataaaggaaagttgatccttatggaagtatttcagctaataaagaaggaatggtagaaatagaatagcaccattttgcaaactcatactaaaataaaagatccagacaatggtcattctaggtaacgatcattttctaacattctaagagtagaaataactgaactggtggtgtgtgactctgatcaggcctctaggtctaatagccagtgtgaagagaacacagggacaggggagtgtgtgacatatcaccagagacacagccagcagcatccagaatgcaggcaccagggcacacgacaaattcaacaccccacgaaaagaaaggtgcagggaaaaaaggggccgagggagaagaatccacagagttaagaaacgcatcagttctgtgccgtatggacctttacatcctgattcaagcagccagctctccctgagaggcctcattatagccgaatgacagtctcgtcataggtgtcataatggtactgcctcatgttttagagtcctcatctattaggcaagatttatgaatgagatgctgatgtccggtgaaagcgggtcggggtgtagacgaacacaggctggcgagagctgccagtggggaaggcagatggtgggtgatgggcattcattctattcccaatagttttgaaaatgtttgaaagtttctataataaaatttaccaataaaatcaataataaaattttaacaagtgaaaagaaaatatgcataacttataaccactgataaaattgatcattttcaggtgaaacagatctcaatgatgcaataacagaagcaggaaagacttatgaagaaattgccagtctcgtggcagaacaggtactaacataatcacacaattccaattaagatttgttgctatctagtccacatatttaatttaaaacctgtcttaggacaaacgtcccaaataagtaccctcttcttttctgtttctgtgtatcttttttaattgtgtttaatcatggtttcttaggttaagacaaagtggatgaatacatttgtcatcaagaaatctaaataggccaggcacagtggctcacacctgtaatctggcactttgggaggccaaggcgggtgaatctcttgagtccaggagttcgagaccagcctgggcaacacagtgaacccccaaaaattagctgggtgtagtggtgtacacctgtagtcccagctactcgggaggctgaggtaggaagattgcttgagcccgggaagtcaaggctgcagtgagccatgatcataccactgcactccagcctgggtgacagagcgagaccctatctcagaagaaaaaaagacatctaaatgaatgcactccagtattgatgcctctgatctgttcttagccatcaggggattctaaagaacaggaaagaatgctggctcagatctgtatggaccattgcttagcctctctgagctgtggtttccttatctgttaatctgcagtggtagtgcctaccctgtatgattcttaagatttaatagctcataaataaaaagcacctgctacagtccccaggacagggtaggtccttgtcatagctacatagcttttattggagtctttagtaccccagtttcaggggctttttagataacagataataagttcccttaagaagaatctaagttattttctaatcccttaattaaaaaaaattttttttcagatgactttaaactatgtgtatggatgcacacatgtgtacacacactaatgtggttgtgggctactttgctgatacttctaaaaaagcattcattttaataacatagctattaaagttataattcagaaaaaatggaaaaatttaaaattaccacttaaaatgattagttttaatatttttatattctctgctcatatttagaagttaaactacaacaactcatttgtttgtgtgtaaacatacagcattagctgaacttccttcatggtggtattattttgggccacgtcaaaataactaattttacaaaccaacttaaaaattacatgatgttttgttgttttctttacaacatatgattcaaagtatggcagtcttgggagttattttcttttagaaaaagtgatctgaatgcttaacactcaataatttagtgtagcacatgcaggatttatagtctttgggtataatagttctcttttccttgattttctgaatttctctgccagtaacaatcagcttgtatcttgttatagccaaagaaagatctccatttcctgatggaatgtaatcacgagtataaaggttttcttggctgcttccctgacatcattggcactcacaaggtaacctgatcgtagacatttatagaagacaacagcaggtgaaggaggcagatgtgcgcagtagtcagtattggttttatatgtttattattaaaaaagaaacaatctataattcccattagaaaggttttgtaactgaattttgacattggtttggggtgtcctcacatatgaattctggttttctctccctttttaaaaatctgtacatcacctcaggcatgagttgtgagtattttatattttatgtcaaccatagtagtctatcgtatattatgatgtacttggatttgttaggaaaatctctgcaaagggctggtctgtgatcttaacagtcctggcatgtggccattttagcattctgctttataacttaaatatcatgaaggggtaccataggtaaattaggtttgtacaacttcagataacttaatataaaactcagaaaaattagcttgctgtcgaaatgtatgccagcagcatcagagttgtaggcctggagcctaattaatgcatgagtatagagttgttccttccagacagcggtaaataacgagcagcgtgatgacactggagtgggaaatgtttggcagcttttctagccgcttccatctgagtctttaaatggattcagcgcctcttaaaaaatcaaaggaaagcccaggacttagaatcagcacacttaggcactagcttataaaatattctgttgtataaaaaaagagagagagtgcctgtgtgcacatgctgccctgtacctagccacatgacttccaaaacctgctaatgcctgatttccattacgtgctactcctcaaatggcagcggcttctgaatattacagagatggtgtgctgtttgcttttctcttttgttgtagcataaaactgttcattttagcttagtgacatttgtcaagaatagcaacctttttgcttccaagggacttgaaggaagttaaatttagatgctttcctctcttcttattttgtggaggtatttcctgttcagtagcaaatcagttatagaatatattagcattgttatattttaaactaatgactaatcatttcagctttattcatactgttgcattttatatttcacagggagcaatagaaaaagtgaaagaaagtgacaaactagttgcaacaagtaaaatcaccctacaagacaaacagaacatggtgaagagagtcagcatcatgtcttacgcgttgcaaggtaagatgaaagggtccttatgaggtgctggtggaagtttttttttccccagcaaagtttcccttgatagagagaaatccagatgtgagcagcagttaagtaagtgagaccttttaagcccctcgtttgcaggatcccggtgctgatgaaaatctgtaatatttatttaatttttcacctgtccaccttatctggctatagatgacagcttgattaaaactgtacattttattatttctgagagacatttaagattccttttgtaatctgtggtatcataatgctctattaaatgccagagcccagcttttagcagtctgtaacctgcgtgccttgggatcatggaatgtgaaggggtttgggtgtgtcattttaggcacaatttttttgtgtcaagaaaaaaaaaagatgaatttctataggtttgagtgtttttgagcagatgagggcagcaagtggatttttcctgttggcggatgggtggatggcacttggatgggcagagaatggagagcgtgttctgttaggaacaaaagccacaaaattgtggtgctagattgtgtcatgggcatgaaagagtaaaacatacttagaggttattgggaaataaattttgattgtgaaggaacttgaaagctctagacttgatgcaggcattaagaagccattaaaagggagtaaaaaaaaatcaatcctcaagggagaaggatttgctggttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggaggtgtccagagccaggccactacggcaaaaacgaggaaccctgattgaagtttcgggttttgaagggtttgaaatggggagtttggttttgaacttgtgtttgaggttatccaaattgagaaatacaaagctttgtataacttcaagtaactgaatgtaaaatgtagaacagtttgcatgtcatgggaatctgtgcagccgctggctttctcagcctggagggtttgggagaaggcggcataggaggcatccgagggaggcaatgaggtcctctgatgacgaagactcctctagagttgggggcaggggcaggggggacagagaaagaaggaatccatgtattcagcaaacatgaagaaagttgtccctcagcatccagtcctcctgccctgtgagaggttgagttctgacagcgtcgctggtgctcaggggcagcaaggcttcccgtactgaagaagggtctcccgctgtcccacacgctgcccagcctttcaccagaaacctgctgaagcaattgctgtgcaggagggagcggggcagggaccccagctgcctgctaggtccagtgcagacacaccagaggctttgaactgcagtcatctgtaacaaatatgaccaagtattttctatttgatcgattctgttagagtaataggctgcatttgggtgatttatctgtattggattttatagttttgaatatgcaagacagtgaaagtcattcatttactggaaagtaatgtttgtcattagcttgttttgttttgtttgttttgtttgagacagtctcgctctgtcacccaggctggagtacagtggtgcaatcccggctcactgcaacctccatctcctgagttcaagcaattctcctgcctcggcctcccaagtagctgggattacaggcacctgttgccatgcccggctaatttttgtattcttagtagagatggggttttgccatgctggccaggctggtcttgaactcctgacctcaggtgatccacccacctcacctcccagagtgctgggattacaggtgtgagccactgcgcccagctcaacttgtttttctaacctcttagtaaagtgatttaccaagaactgacaacagcagccaaccagattaggtcaggttgatgattaattgtaactgagcagagaaaccaggtgttgtcatttgaaaacttgagggaaaactgattgatgttctgatttgggttgtagctgagatgaatcactttcacagtaaccggatctatgattacaacagtgtcatccgcctgtacctggagcagcaagtgcaattttacgaaacggtgagtgggcgtccacgtgcctttcgcatgtgcttgaggagagggttcctggtaaaccactttgaccatgtaaagttaatctgtttgtattctttaatcctaagtaataaaccaaaggagcctaaattttggacaggatttttttaatctcctaattccatctgccctttgctttttggataacactgggttaaaaaagattttcttctgaagcaggggtcttggatgctagttgcaaggccccaagaagttccttattgtgcagctccttccccccgtcacagcctctctgtgcctctgtgcaccaggaacggtgctgaatgagatgaggtcacccagccgtccctgggactccgttggcagctggaacaggagcctggcaccacacaggaaaccaaaggcagcctttgctttttgtgaatgaggttttcacagtgcgccatggaaatcgcagagagaaaaccaaaaaagcgagatgtgggatggttttattcacaaaacaataacgaaaacttaaatttttcttacctctgcttagtaattttgttgtttaccagagtctatagaaaacaaaaatctagtagcatgtctccctcagacacctgcaggtaaggtctgtaatgtagaatccagcctccgctggcggccttgctgcctacccagctcccctctggccatgggatctaagccatgttcatggggagtggtgagcaagccctctgctcagccatactggtggcatctgcgagctggacactgctgaaaacgcctgtctccagcagccagttcttaaaggagaactgtgcttgatgtacctaatgcatatttgtgaattgtgtcttggacagttggtttgggagactaacttacgggaggaactcacctaagccctgtcctcccttacaggacgtgggccctatgctctttaaatgcacacttttcccgtcagttggtgccattgtggatttgcctttcattgtatattagaatataacagattacatttgtctgtgtgagaaaataatgcaagggcaactctcaaaattttgatagtgttgatttattgattttcaagtccaggtatggtatagtgacattgtaattcagaatagaaaaccatgtatttcatcactgtctttgcataaacctaagtagctgatataacattgttaggttttagatctaagttttatggcaaagtaacccttaagttactaaaatttgtgtatgtgttcatggagcagacatatattgagtgtttcttatataccaagccctcgtgctggatgtttagcatccagggatggataagacagctgtgccttcaaggagcaagaggccctggcgcagagaccactgcagcgcctcgttagcttcacaggcaggctcgtgctgtctgcacactcagcagtgacagcagggtgtggccagggcgacacaaccttcaggggattctggaagctcatactcctccaggaaagagggggctctaggcaaacatgaaggcctgagcccccagctcatctgaggaaaagcaggtggtctggaagcgccgctagggcagaggtggggagcatgtgtagacgcctcccggcgggaagggaccaccagggccagctcgggccccagcgctgccggtgtcattcggggttaaggtctgtccagcagcaacgcggggcagggctggtgccaaaaagaccagttaaagaattggaatttgtgtcatgtttaacttgttggagttgtgaataaagaacactgtgaggtcgtaatgggagtgatatctcaacgttgttttgttttgctttcttgtcagattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtggaaaaaaagtcagtatttggagaggagagatgaaggcgtggtggaagaaaaggtcagtctcgttgtcaagcaagtgacgtcagttgcctcccaccaggagcagcagtcccgggatgtcaacccactgcatggtttgtaggtgttggggtcaccaagaaagatgactcacagaggcactgggtggaacaacgtaacttgattcattttcttattggtgactttattcactttctttcttttgtggtagctttattcattttcttattctgtcattttaaaaatgttttcttacaaaagtacctgctgggtctggggtttgatgttgccctacttacaagcaagtaatttagtctgttgctgttccatggatactggaaggggccatgagactcgtgggtctactcacatagagaagagacagcatgatctacttctgtcatgggcttcagtcccagggagatggtctgtgggcaccccccatccccccgcccccggtgggcagcgttgacaggctgtgcatggcagcctctcccggcaccactggtctacatcttcactaaatccatagatccctgcctaacaactgggaatccagaatctcacagtcttgtttatttatttatgagataatctcactctgtggcccaggctggagtgcagtggcatgatgtcagctcactgcaacctctgcctcctggtttaagggattctcctgcctcagcctcccatggcgcacaccaccatgcgtggctaattttttttgtatctttagttgagacggggtttcaccatgttggccaggctggtcttgaactcctgacctcaggtgatctgcccacctcagcttccaaaagtgctgggattacagacatgagccaccacacccaacctcacagtctataaagtagtcaaagtaaaaaaggtgtgatggctgagcagaactgaacagtgatgggtgagaatggccctgtttttcctgtgtgtgtgtaactcaattttcccaacctgttcgattttaaatccctttccgcaagcaagtaggaagaatgagttccccttttgggagaatattttccgtgggtctctcgcactccacctggcttttttgctggctatgtcaagaacacagagccctgactgctcttcacccaggccgcccctccacactgcatctgtagcaagctacttgagggacaaggtcatgttttggaaggagtatgggcttgcctgctgcttgctgtaaaacagtgggttttccagctccaggtcctcctctaaaaacccactgtctgagcaggcaccctctggccactcaaggttccaccaggggactggcagggcaaggagaactggagtttgtgttacttgctgtgtcatggcttatcaagtcctttgcccctgacccaggagactgtctcatgtcccctgccagtatccatggaacagtaacagacgtttgcttgtaagtagggcaacatcaaatccctgacccagcaggtgcttttgtaagaaaacattttttaaatgacagaataaatgaataaggccaccaaaaagacatacactagcctagactgttggaagatgaggaatggtctttcacaccccgtcagcatacagtagaaaagaacaagcaagttgagatttcatcaaagcagaaatgagaatgttttgaatgccattggcaattcaacggacaaaaagcaaggttgtctgaagaccatgaatccccatggggagaggatggcttcgtttctgacttgacaataagctcagaggtctttgggtgggatccatatcttagaaaaaattgccaagtccagtgaatcattctgtaggatttgtagaactctgaagacagaatgagagtgaggtcatgtgagcttgactccaggaaccatgtgagctttgaaagaaccactctgtcgaagcactattcttcaaaggttggggaacttcccacctggctcgactctgagaggaggaggtacctagtgctgggtgagggaggccaagaggtgggcttaggggaagtcattaattctggagagaagccactggctgtactgaaaacatgctagcttgccagcaagctggaaaggactgctctgctgggtacgaggtggtggtgagcatgggcgtaggtggctgccaccactaaatgtccaaggctgcagggaacaggtagctccatcagttgtccttaaaacagtagttctccaccagaagtacttgtgctctccaggactcacttggctgtttctggagacagttactgaggggtgttactgtcatctagtggatcctacagtgcacagcacagcctccgtgataaagaactatctgcccaaaacatcagtaatgtcaaggttgagaagccctgctttaaagcagacaactgctatttgccttgtggtcaataggtattttcaggtacattcagaaggagctcaaatgcctgtggataaggataaaaagccattatcaataaaatctaagaggcccagaaatagagtgacagggaaatctctaaaaatgcagaactggggctaggaggtaggccatgggctattaaggattcagcttctccatttgttctttgggggtgtaattaggagtgatctttgttataaagtcgtgtttttctgaattttttttacaatgaggttgtattataatccaaaaaaatttaagctgttagatttggtttcccaaatcacgtgttgactaaacgttcattagtaccggctacgaaccaggcactgatttgcctttccacatacaaatctcatttcctgcttatactatgggatgtgggaatcgtcagaaggttggagactttccttccagtgaagaaacacttggtaatgtaaagatatttgaattgtcaggaaccaagagtcctaactctgatgccaatacctgtcacttgaacgagtcagtgagctgctgtctactcatctccagcgtgcagggatgaaaacagatgcatccaaaagcccttcccacctgcgggaccctccctacatcacttagagaagagcagggacatggttccaggccaggggcagcacctctgaaacagactcccaaggcctgcctcccaagtgtccccctaggtgaccctgacagagtcacctacaaaggtggcagatgctctttttcccttgtttcagtatcttacggaggcatggatttctgttattccatgtattacaattatttacacacataatttttagatcctcatttgtcccaaatttggctattgggaatctctcttatgtaaattggttgattattgtggtctcatgtaattttgtatcctttatctgtgctttctttgtgtttttttcatgctatggcagtcttcataatgaccctacacataagtctatataccagtttccaagagttggacatttagatgtgaaatttttctttagcttttatttctgactacatcagtgagcactaatgcaccatcgtcatggggtaattaagacaaagatttttttattttattgtaaaatatacatagcatgaaatgtaccattttagccatttttaagtgcacagttctgtggcattaagtacttttacattgttgtgtaaccatcaccatcatccatctccagacctttttcatcttcccaaactgaaaccctatacccattaaacagtaattccccacttcgtctccaccctggcacccacccttctactctctgtctctgtgactgtgactgctctagggacctcataggtggaattagttgatatatattctctatgactgacctagttcacttagcatgatgtctacaaggtctatcataaagatttctccatgtgttttctcataagaatttttataggtttgattctgaaaagacaaagtatttttaaagtatagttgtaaaacatagggagacctactcaaactactccaaaaaatagaggagggaatacttccaaattcattctactaggccagtattaccctgatatcaaaaccagacaaagacacatcaaaaaaagaaaactacaagccaatatctctgatgaatgttgatgcaaaaatcctgaacaaaatactagcaaaccgaattcaacaatacattaaaaagatcattcatcatgaccaaatgagatttatctctgggatgcaaggatggttcaacatttgtaatgtatcacaacaaatcaatgtgatacattatcgaaacagaatgaaggataaaaatcatatcatttcaattgatgctgaaaaggcatttgacaaaattcaacatcccttcatgataaaaaaaaaaaaaccctttaaaaagggataaaaggaacatacctcagcataataaaagccatatgcaacacacccccagatagtatcattactaaatgggaaaaacctgaaagcctttcccctaagatctggatgctcactttcactacttaacacagcctagctatgacgagaaagaaaaagcatcccaattggaatggaagaagtcaaattatcctcgtttgcagatgatatgatcttatacttgaaaaaaacctgaagagtctacacacaaaagcacttatagaactgataaattcagtaaagttacaggatacaaaatcaacatacaaaaatcagtagtggttctatatgccaacagtgagcaatctgaaaaagaaactttaaaaagtgatctcatttacaatagccacacataaaattaaatacctaggaattaaccaaagaagtgtaagatccctataatgaaaactataaaacactgatgaagaattgaaaaagacaccaaaaatggaaaaatattccatgttcatggattagaagaaaaaatattgttaaaatgtccatactacccaaaacaatctacagattcaatgcaatccctatccaaataccaacaacattcttaaattttaaaaaatcctaaaatttatatggaatgacaaaagatgcagaatagctgaagctatcctcaacaaaaagaacaagacattacctgacttcaaattatatgacaaagctatagtaaccaaaacagcatgacactggcataaaaacaactacatagaccaatggaacagaatagagaacccagaaacaaacccacacacttgtgaattcattttcaaaaaaggtgctgagaacatatgctggggaagacagtatcttaaatggtgctgggaaaactggatatcaatatgcagaagaatgaaactagaccactgtctcttgccatacacaaaaatcaaattaaaatgtatttaagacttaaatctaagacctcaaactacgaaactactacaagaaaacattgaggaaagtctccaggacattggtctgggcaaaaatttcttgagcagtaccccaaaaccataggtaaccaaagcaaacatggaaagatgggatcaaatcaagttaaaaagcttctgcagagcaaaggaaacaatcagccaagtgaagagacaacccacagaatggaagaaaatatttgcaaactacccatctgacaagggattgataaccagaatatataaggatctcaaacaactctataggaaaaaatcttattatctgatcaaaaaatgagcaaaatatttgaatagacatttctcaaaacacacacaaatggcaaacaggcatatgaaaaggtgcccaacatcactgatcatcagagaaatgcaaatcaaaactacaatgagatgtcatctcaccccagttaaaatggcttttatctaaaaagcagtaacaaatgccagtgaggattttgagaaaaaggaaccctcatacactgttgatgggaatgtaaattagtgcacccactatggacagtagtttggaggttcctcaaaaaactaaaagtaaagctaccatatgatccagcaatcccactgctgggtatctacccaaaagaaaggaagtcagtatatcaaagagatgtctgcactcccatgctagttgcagcactgttcacaatcgccaagatttggaagcaacccaagtgtccatcaacagatgaatggataaagaaaatgtggtacatatacacaatggagtactattcagccataaaaagaatgagatcctgtcatttgcaacaacatggatggaactggagattattatgttaagtgaaataagtcaggcacagaaagacaaacatctcatgttctcactcatttgtgggaactaaaagttagaacaaactcatggacatagagacttgaaggatagttaccagaggctgggaagtgtagtggggagactgaaggtggggaggtggggatggttaatgggtacaaaaaaaaatagaataggacatactatttgatcacacaacagcgtgactatagtcaataacaactgtacattttaaaacaagtagaagtgtaactggattgtttgtaacacataggataaatgctggaggggatggctaccccattctccatgaggtgattatttcacattgcatgcctgcatcaaaacatctcatgtaccccaccaatatatacacctactatgtacccacaaaagttagaaaaaaaatagagctaactaggttggaggggaatctgaggactgagctagtttcagtgggcactgactgaaccctgagaaggccacctgtgtcccagggccctgttcaaatgccacttgccttcccaagttatggtctgaatgtgggtgtccccataaaatttacatgttgggacctaatacccaatgtgatggtattaagaagtggagccttttggaggttggagggagtgtcctagtcctttccaccccttctgccgtggaggacgtggcaacaaggcaccatttggaagcagagaggtctggccagacgctgcatctgcggcaccttgatttggcacatcccagcctccgctgcagtagcatggtgagctactatccagtctaaggtatttcgttacagcagctgtgtccaactgcgacatcaagcttacctgaccccaccccccacagcattgagtagctccgacaatgttccctgacctttgcacacacctgcccttattccatttctcaccgttgcttgcttatgactttatcaagctagcttcaaatgtggcttcttaaatgtaaaaagtaaatggtggaattatgcagccattaaaaattatgtttataaaagtagttctaaagcagcaagggaaagctaatgccaagagcagaaacacacctgcaggtccagtttgtatttttgtacagccagtaaggttcctgctatgtaaaaacagtgcatgtaaagaaaaagatggaaagaaactactttgaaaatattacattatctgcttatatacctccttctgtccttggctcgattctctccttcctctgtactcgctttctcttcctaggtaattacagtgacagccttgatttcaggacaccctttccttgactctttttttttttgagccggagtctcactctgtcacccaagctggagtgcagtggcaccatctcagctcactgcaacctccgcctccggggttcaagggagtctcctgcctcagcctcccaagtagctgggattagaggcactcgccatcatgccctgctaatttttgtatttttagtaaatacgggggttccaccatgttggccagggtggtcttgaactcctgacctcgggtgatccgcccgctttgacctcccaaaatgctgagattacaggcatgagccaccgcacccggccttcttgactcttaaatgtgggtctgtatagcagcctttcttggtagctgcacatccgcgcctgtccttgtccactcactgtccccacctggaggtcccatggccgccctgaaaccaactgtgtcctgtgtgtgctcactctctgagtcattcccttcctgttctggagcccagggagaggcaccaccctccagtcagcagccagaaacctgggcatcttcccctgccctgcttcccgtctatctccaagccagtgggtctaccatggaaacatttctgtaattcacccatgttgctctatctctgcccctccttgctagttcacaccactgtcatctctggcctgaatcattgtgatacccctttaattatctctgcatccaaactagtcctctataaataacccattcccgccactctaggcagccagaggagctgcgacaaatgcaaaccaagtgtcgctctggtgactctcaggagcaaagctggtttggtttcttttggtgggggtggtgagagttttgtttgtttgtttgttttggggtttttttttagagaaagggttttgctctgtcacccaggctggagtgcagtgacaatcacagctcactgcagccctgacctccctcaactgattgtcccacctcagcctccccaagtaggtggggctacaggcacccaccgccaagcctggctaattttttcaatttttttgtagacatggggtctcagcacgttggccaggctggtcttgaactcctggcctcaagtagtcctcctgcctcgacctcccaaagtgctaggattacaggtgtgagccaccatgcccggctcaaagccaggattaacatggagcaccggcaggtgtcatctctcctgacatcctgggctccttccgttctctgaacccagcctgctgtgtcccacctggtggcctgtctgcttgctgtcccttcagctaactgtggtccttctcaggctaagacatggcatctccttgaggcccagaccaatcagtgcagtcatcactagcccttattagatggagtggattgaatttcacctgacgttgctcccctctctgtctaaggaagggtctggtgagtgggatcacgtcagcagagctcatttcctgcatgtgattctactactaccttctactactaccctccctttaccgctgcactcagtcattatttctatctgatagcttaaaaaaaacaaaatagaaaaccactactcatacctgaccccccaaaatatactggtagctgctcagaggacagaattaattttaaaaataatctaaattaggcaaacagagcgtgagaagccgataatcacgcaactccctccagaaaaggaagtggagcaggcgggcgcccagctgcaagccctcagaaggctcagcctccagcgccaggacctgattttattactaacaaggtgcggtcctcattctttgggtctgccacatgcctcacggtaattttccaggcaaactatatcacatgatactggctttactgtccaagcaataagcgcagagtctctggcagtttggacttctctgagattgcactgctgagcacgtagctgcggcggtcacaggaactcacatgccaaagaactgggaagaatgttttaaaaacctggaaagaaccggtttccttttctgcagcctaacaaatacctccttgagggaagtaggaagctttcagaactccctcactatccagaggcttatcattgtgtgaaggatcagagtttgtcaaggcaaagagaatcaaaactatttactcaggcttggaattgatcaggtgctcgggaggctcggagcaggggagcggcggctcctggactttaacccccgtgtttgtggaagcagtgactatgatgatgataggagagctggcgccctcacgcgcttgtcacctgctgcgggcatcagtgagcgcttgctgccgcctctgagataaggagggctctgtagaaactcacctgggccacctccactcggaagccctcctttctttcctgctagacaagaagcgcctggagcagccgagggaacacacctggtggcaacgcctggttcccactttcgaacctcaggattgagagagggatgaacgcgggaagtctgaggacacactctgtcctgcccttaactgtgactgtccgagccacctagggggacacgtgggaggcagtcccagggaggctgtactagagaggtgctgcccccaac

SEQ ID NO: 357 - DNA, 64443 bp, Homo sapiens
tgactgtttattgatatgcatattttctgaaccatttgagagtaagctggagccattatccctgtttacccctaaattcttcatgtatctcctaagaacaagagcatttgcttaagtaaccagagttcagctatcaaatttgggacatgtaatacgacccatacgcacatttaccatggcaattgcgcttgctagtccaggatctagtgcagtcgcacattgcctctatgcattgtgtcttcaggttcctttaatctagaacagtttgaagttgcggtttacatatacttgttcatgttattctcttgcagtatactctaaaccccatgagagcaggggctgggcctgcaccacctaacacagtgccctgcacagagctggtgccagtacacaaacaacaagtcagtgtggaatgactggtccccagtggcctcttggcatctgtcacaagcttcagctaacattcctggagcacctactgtgtgcttggcgctgtgctgggcttgtcagagctcacagggtccaggctgcccccctccgaccccattccatggggctcacatgctgacaagagagataaggaggagggaggtatggccgcagatactgtgagaagaatgcagcgagggctgctggccatggcaggagggcagagcagtcagggaaggcttcctggaggtggtggctgatgtgggccctagaggatggggccacgtagagcagaggagggcatttctgttgctatgagaggaaagggaaagcctcagagaagggagatgtgagggggggcctctgggcaggggcaatgaggttcttgtgacctattgccattccctcaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggaggtgctcagtgggtgctgccacgggcggggtggggtgggcccgtctgatcagagggtgctgatcccagggagggcatctatggatgggtgggctgggcactgccctctgggattgtgcccacaggggagcagcactgccttccaggaaaaaatattcacagatgggtaggcagtgcccattgggtaaggagacccatgggcaaaaaggggcactgtccccaggaaagataccagcaggggcagaagagcacattggcccctgggtccccagatggggcgggcactgcactgcctgacaggagggtatctgcaggggagcaggcagtgccaagcagagacgcagccacaaatggaggagcgctgctcccgaacacctggagccagggcctgcatcccttctggctcttaagagtgtgggctcacaggtcccagggagtgggcaggggaggagttaatgggtgaccatgtttgctgctggtcacaaatgaaaaccctactccctattcccccctccccacagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaaggtgctggcgggcagggatggcagtagggggtctgggggccccttgcagagggtggtggctgggagctgcaggcctggctaggtgtcaccctctctccactctggtgcccacagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcaggtacctgggcatggcaggcaccgagggcacaggcacagccagcagatggtgtgactggcatgcagggcatcccagccctccatcacagtgacgggaaggggaggcagagctgcaggggtcaagaaggatgaggcttcaaacacaggggctgttgagtgcaagctgacgcacactgggtactctagaaacacatgctggatgatgggtgaatggctaaggtgggagggaaaaggagtccaccgagcatgcccggagcttattcttgcaaagcccacatgattcctggctgggcagcatgcccagcaccctgcttccctgagtggactctggcctctcaccaaggttgaggaggggccatgttgaatctgtgccctccacctcccccatctccctgagcacagctacatccatgtgtaccgtgagctggagcaggccatccggggggctgatgcccaggaagacctcagatggttccgcagcaccagtggccccggcatgcccatgaactggccccagtttgaggtgaggatatgtggggatgggaaggggagcctgaagaggctgaaaggtgcctcagggcatagtcccccagcctgactgctccactggccccaccaggagtggaacccagaccttcctcacaccaccaccaagaaggagaaacagcctaagaaggcagagggagtggcgctgaccaatgccactggggcggtagagtccacatcccaggctggggaccgcggcaggtgagtgcctcctgtggagcttcctggggccaagagggacccacactctggggcagctgagttttgcttcagaagacaagaaatggtctagatcatagcaactatgtctcctctctaaaagatagtggtagttcatcactctaaagcagccgtccccaatctttttgggaccagggaccagttttgtggaagacaatttttccacggatgggagcggggtggttttcggatgaaactgttccacctcagatcatcaggcgttagattctcctaaggaacgtgcaacctggatccctcgcatgcgcagttcacaataggggggttgcgctcctatgagaatctaacgccgcggctgatctaacaggaggtgcagctcaggcgataatgctccctcgcctgtcactcacctcctgctgtgctgcctggttcctaacaggccacggactgtctgcagccccagggttggggaccccggtccagatcacaggaaccaagcctcctctctaaaagatagtggtagcatatccttctagagcacctactgtgtgtggcacggttctatgcactttccatatgttaactcattcatgctcaagtgcgtaaatattaccattttacagatggagaaactgaaacccagacaggttaagtgacttgcccaagatcacattgctagttagtaaacctcagagccagatatgttgcccaggaggtctgactccaggatccttgctcttaaacattaggtggtactcctcctcccggatgaaggctcagatgtgccctggggtccccttcaatgccctctccctcgagggctgaataataacgcaaatggtcctgcatttaaacatcggtttaaagagctcatgagggtcacccctcctatgtggccaatccttgctctagccttggtagaattcgggatcagggctctgattaggaggagcggttagccctcgggatgcggtacggggagacattgaagctggctccttcctccgcgtctcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggtaggacggctgggcggggcagtgcctgagagaggcttgggcctggattgggtgtgtggtggtgcaggggcggtgcctgagagagaagcttgggtctggattgggtgtgtggtggtgcaggggcggtgcctgagagagaagcttgggtctggattgggtgtgtggtggggcaggggtggtgcctgaaagagaggcttgggcctgcattgggtgtgtggtggggtagaggcaggatctgaagacgggttgcgaggatttgcagggaactaaatggggcgtggcctgggttgtgggcgtgacctgggcccaggatgggagtgggggcaagatttagattggttggtgccaggggcggagtcagaacctgagaatagtgtggatgcgaggtctggttttggggacggacccgacacccagattaggtgaatggctgaggtaggccaagacccctatgccaagggtggcacgtgaatgttggcgtgggactggggctggtttccaggggcggggcctaagaatctaaaacccagtgcagtaatcaggaggtgggtattggagggttcccctagcagccggtgcgttgagggaggggcagccttctctctgagcccctccctgtgttctctttcccaggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctgcgcattgtcatcttgagtctgtgcaccttcagtcctgggggtttctgagccctctgagagctatttgtggttgggatgcaggggggtaggggtggtgcccgagcaggactgggtgctgtcctggcccaccatccacagactaggccactgagagccggtcccttcgccctgcgggggcctgggtcttgtctggactggggagggtgatactggaggctcctggagctctggcccattcaggttccgggtgcctggtgacaggccctgaccaggagagctggggcattcagggttccacattcatggatcaagagtgaatgaggtcctcaaataggttttgctttttaaagcagaattctaaaagtgactgctgaggcccacggttcctggctgtccacagtgccaagctccctgtgcggtgatgttgggctgtgccatgccttcctgcgtctcgcctggctctgaatgcatttctgtgtgggacccgtgggagggctccttggggagaatttctcaggggcatgggcaggaccggagctctgggttcttggctgttctgccagccccaagcccagcccttgctctagctccctgactccccctgcatccagccccaggggatctcttccggggtatcgcagaagtcccagggccggtcccagttccgctgtcagctcactgtgttcccaccctcacctgggcctcagcttccccagtctggtgagatgtctctctgagggtcctctggccctggcagcctggcagggccgtcacacaagcccattactcggggcaaatatacccctgtcccttccctgacaccccttgcccccaacctcagggtgtgccaggcagggagaaaggttgagatggagattgaatctatttgccaccccatcttccttactcctcctgaatctatttgccaccccatcttccttactcctccaaacttacctctatgtgaagccctgcttttagccaaacagagaaatcttcaaataaagacaaaagattgttgtattgtcttacctgcacaggctgttccatttagtgatggggagccctgagggtggggtcccatggagaagggtcagagaatacccagccaggtggggttctgctggggaggtgtttggaggagggagatctgcagatcgctgccagctcacaaggtgtcactggatgggcgtgtgcctgccaaggttcatgggcagggagctgcctcacccaggcccccacatctaccctttccagagctgctccagctttgtactcctagcctctactccccatacctatcctcctgtccaacccctgcctgagatctgaggcctttccaggcccaggcccagctggggacatacaagcaagtgtctgcagggactcagttgggagcagggcaggctggctggagacaaaaccagttcagcagagcctggttctggccagggtcccagtctcccccccaccctcctcctacaagggagtgagacacagcaggggcccagcgaggcacaggcctggggcagggccccctcctccctgcagtacaatcccagctgacagatgccaaggtgctatttgctcactgccaggagcaaactttcttctgaagacaataaaattgctgagggcagaaggcagcagtacagggtagcatttaacccttggtggtctggatagtgctggctcccctgctgtttcctggaagccaggcctcagaggataagggtgatagaggaccaagggtgctgagcggtcagaaagccggagggctggaggggcagagagagccctgtccttggggagagacaggtatgagttattctgtcaatcagctgtgtgaccatctgcaagtcacttaaccactctgagcctcggtttcatcatctgcaaaatgggggagtagcccctacttcatagttttgttgggaagataaatgacaaagcacctagcccatagtagaccataaggacactgagccgggtgataaatgtgagggaagtgggaggaagctggatgagttgctttgcccaggagagtgggtggtgggtcctggtcacccccagcatgcccacagacaccaatgcacaccctcttcccatcacacacgggggtctcacacccactcacaggagctcacatcttcacagacagcactgctgaggccttcaggaaacataaacaggagccaaccaacctctcttccaccctgttagctgcaaagccctgctctgcaacagagcaaaaggatgcgaaagatgccttccccactccggtcctgcatgtagcacctctttagcaccggccttgccgcctgcctctcagcccgaacagcgacagggaagatgaggtggctgttctagcccctccttgattttgaagcctcactatctctctcccagaagcatctaccaatcaattatcccttgccctttaggctcagcccaaagccacctcctccagaaaacctcccttgactactccaggccctgtgaccacagccgcatttgaccattgatgacctcggggctgtgccattcactgcgcagacactggggacatgtcagttctctagtatctttattatccattcccgggggcactcctggctgcccaactcaggggtgcagatgtctccctgcaccatgccaggtgtggtgcagaatgggaggcagggggatggagcagagagaggcctggactgcctgtggcctttgtcgagtcactgcccttctgtaggctctgctctggaaatgctggggtcagaggcaggtgttggggagcagccctgtctccctctgtcctccaggggagcagctgggcctgaggaggaagcacccctgccccagggtcccgaaggccccagaggacccatatccccctggggcagttggttgcccctccctgaccttgggctctggaaggtcagagcagcagagcagactgcccgttttcccccatctcagggcctggctgaggcagggcaggcaggagagaggcccctgagggcgggtttcaggccctgggccaggcactcagatggggtgcacgaactggtagacgaggcgctgggagatgtctggcttccggatgatgcccttcttgtaatactggcggatggagcggctcagcttgtcgtagttcatggcgggacggttcttgcggatgccccacagccgggccacctgggctgagtcctcaattttgaagatgcctagagcaggagggccccgagagagccagtggtatgagtgaggtggcaagaaggagaaagacgcagaccaccaggtcagcctcgtggcgaaccaagggaccccgtgcagaggcctccccctgctcgggtggggcggggtgtgggggcccaaatgcctactcccaaggtgtagttgcggtgaggttaaagagacgtgtgcaaagcaggtgccacaggccccagtgaatggcagagaatactctggagtcacaaacctcccggtacaggtgagcctgtgtaccttagtgggttccctggggccctgcaggcctggcccttgccaactcctgcttctgtgtggggtttgcatgacctaatgcaaagtcctgtgtggctcccagcagtgcccacggctcacttggcaagagcatcccttccccattacaggtgtctctgtagttcccaagcctgaaacaacctctttgctattctcaggcagttcggcctgtgcagccctctctggcaggattaattaatatgagatggtggagggagagtggatttggagctcgttccaggtgctgtgcagtactaaaactcctaagtgagacagagtctagcaggagacagatgtggacacagattgcacacagaccccagggctgtcccatgagagctgcatatttggcatctaggacaaaggtggggatcagcttcacccctctgcccgcccctgcccccatgcaccgtgcctggcagaagcccccacaacctccatgctcactggccctgcagcgccccttgggcaccctgctcacccttctccttgttgagccacctaatgaagcggccatagctgtggggcttgagtagcaactccttgaggaactgccacaggtggatgggctgcccggagcatgatgagtccacctcgctgtcggtccagctctcctcactggtcgaggctgggtggccagggagggtggcggtgagtgggaatgggaggccagtcccggcttcattggcagccacccctccaccccacccgagcccccgcctccaccctgccgctgcctggctcaccacagtagtgaatcgccccaggtgaagtccgctctttcatccaggccgctgcagggcaaggagagggggttggggacccaggagaggccccgagggtggaggaggggaggcgtttgggtgggactgtggggccacaggagcccctctgtggctgggggttgcccctgtggctccctgcctcctgccaacctggggaggcaagctggttacaagaagctgcttcctggaagaaaattcaggatttcagagctgggaggggccgtaaagggcttgcatgcaaccccttgttcagatgaggacatctgacatgggggcttgcctgggctggggcggggcactggtctctgacagggtcctatgagttggtcctgtttcttactccttgactcaggcaccacctcctccaaagcacctggccctgtgcaggcagcagtgggtgcccactgagatcaagacaatttagacactcaggggctgacacgcagccattagaaatttagggcaggccgggcgtggaggctcatgcctgtagtcccagcacttcaggaggccgaggtgggtggattgctcaagcccaggagtttgagaccagcctggccaacatggtgaaaacccgtctctaccaaaaaatacaaaaattagcagggtgtggtggtgcacctgtagactcagctactcaggagattggggtgggaggatccaatgaaacagggaagtcgaggctatagtgagctgtgactgtgccactgtactccagcctgggcaatagagtgagaccctgtctcaaaaaacaaaaactaaaattaaaacagggccactgtggacacggacaggggcaatacccaagacatactgtggtgtgcagagcagtgtaatactctgctactacttatgtcaaaaaaaaaaaaaagaataagaactgcatatatgtaaatgtgctcgagtattcatagactttccctggaaagatactcaagaaacttgtaacagtggttccctctagggaggggattggaagctgggggtcgggagcgggagggggaaactgttcatggtacactacttttcactgtggtctattttataacatgcacatttattacttctttaataaaaaaaaacaaagaaaacaaagaaaaacaaacaaaattttaaaaggaaaaaggacttcctagtatccacggttgtccccagctctgacatcctgcatcctcacagtctgacttctaccttttaacctcccaggtgctctgtcccaaagctctggggccttgaccagggctgggagtgggttggggtgaagagtgcaccaggatccaggaggcagctgaaactggggctgagattcagagtggagtccagttgggggccaaggggctgctgccctagcagagggcaacctcctagccagcatcctgtccctggcttggagcctgggaggggctgctcccagccatgccacatcctacctgacttccagatgtccaggtgggcgtgcagcacatccccacccaggggcgagcgctggcggaactgctcctccgacatggcgcacagctccttgcccgccagctcctggaaggccttgcccatggggggcagccggtattggtgctctgtccacaggagccacttctgcacattgctggggctccagtccatgggatctgggcaagaggcatcccctcagctcaggggtggcctgagagcaccaccctgctgtgatggggcacccatgggaacctgtggcctgagaccatgtgctcttggggatggggataggtcagccccagacaggcccctgagggcccctgtggaagtgggtacccaagaagagagtggggcgagaggaaggaaccagggccctaaaaaatgaacttggttcagggcagggtaacctggtgcatctgtactgcccgcctcacccaggccttgggtcctcccagatccctccagcctctccaaaggacctttcgagggagcctcagccctagagggacagtgacactctaccagaaacacctgggcttctccatcaggtacttcttgcctttcccaaacccctcaaggaaccagagaaacacctacctgggaattagtcttagaaccccaccattctctccagcccctgtatcttacagatgaggaaactgaggcacagggcactccatccccttgtcctccacggaataaagggctagacgcacaggagctgctccaggcacatgtgttgaataagtaaatggcagggcacagggtggccatggggcagccacaggccccagaggccaggaggggagcccttggctaggtcctagatgtccccctggggtgctgctctggggtgagcctcataggcctataggtgggggataggctggtgggcatggtcacaatggggcctccaagtgaacaccatggtccagccagtgtcccagctgggtgacctgcaggctgggctgcccccacttaataagcccattttcctccctgaggtcaaagccatttgtttctgttcccattgttgagggagcagggccctcccctccctagccctgtgggtggggaggaggtctgtgggagaactcctggagtcggcctggcatgggcattgggaaacttggggcatcggcaggagcagcttcaaatgaggacgtcaacggggcagctttgggggcaggggccgggcctgagggatgcatgaagacccctgcttcccagggaaagctgcacagagttcagtgctgcaatgccagggcctgaagatgagggacatgggtcaggactgcctgaagctggagaggcgacagcaggacagaggactagagactcagcagccccgccacccacagcatcagctccataatcacgccttccaggtctggctgacagacacatgtatgccaggccctaggaggtcccctcctcatcggggccttccgtcccacaagaacagtgacacatttctctatttatttgtgatctgtgtcactcactatcatgtcagccctacgaacacaggggctgtgttgtgttcaccactcaattcccccgtcctagaataaggcttggcatattaggaactgcttttcggcccagagaggtagctcatgcctgtaatcccagcactttgggaggccaaggcagacggatgacctgaggtcagaagttcgagaccagcctggccaacatggtgaaaactccgtctctactaaaaatataaaaattagcagggtgtggtggcagacacctgtaatcccagcttctcaggaggctgaggcaggagaatcgcttgaacccagaggcagaggttgcagtgagctgaaatcacaccactgcactccagcctcagtgatagagcgagaccctgtcaaaaaaaaaaaaaaaaaaaagaagaggctgggcgcggtggctcacgctagtaatcccagcactttgggaggccgaggcaggcagatcacgaggtcaggagatcgagaccatcctggctaacacggtgaaaccctgtctctactaaaaatacaaaaattagccgggtgtggtggcgggcgcctgtagtcccagctactcgggaggctgaggcaggagaatggcttgaacccgggaggcagagcttgcagtgagtgagccgagattgcaccactgcactgcagcctgggcaacagagcaagactccatctcaaaaaaaaaaaaaaaaaaaaaaaaagaagaaaaagaaaaaaaaaagaaatgcttattattgaacaactgtctattgagcatcagttatattcaaggtgctatcctagcatctggggatggattgatgagcaaaacaaatgaaaatccctgcctttgtggagtgtacattctagtggaggacacagagagtgagcgagatcaacagatatggtgcggcacgtccgaggagtgtaagtgctatgagaggaagcaggtgagaacagcaggtagggatgtgagcagaaatttttcttctttcttttatttttcatttttttgtttgttttctttaccatgtcctgtgctcatgggcagcaattttaatggaggggtcagggaaggcctcatgcggatggtgccatctgagccaagacctgaaggaagtgagtcacacagatatttgggggaagagcgctctaggctgaagaagcagcagcgtagcaaatgttgtgggaacagcaaacaggccagtgtggcgggagcagagtgaatgaggggagagcgaagtccaagaggaggtgggggacacagagcttgaattcatatcatccagcacctaccagtggggaccctaggctggcatggttgggacactagaggtggacagaaaccttcctggcccaggctcacagctgactgtgtgtagaagtgccagcatccccaaagctgcccgaggctgggccagaggtggccagagtccatccagcagtgccccgacccaccccagcgacctcagccttgcctgtgacccatcttacggaagcaggcacatggagagggctcacctgcggtgatgttgagcagcttgcaggccgtctcgatgtccttgagcacttcgcccaccaccatggactgcacctgctccagcgagtgctcctccaaggtcagcccgccgggcaccaagtccaggctgcccgctggggcttggctgtcaatgaccgggcactgctcaggctcctcaggtggctcctcccgactgctggccccaggggccttggctgcccagctgctgtcctcagggtacagcatgtcaaagtaggagaggtagaaggcggacaggccctgctcgggcgtggcgggtggactgggactccagtcccgtctctcgagacccactgcccccgctgccgccttctccaagcctgtccgcgacaccgtgtcggggggcagcaggaggtggctgggggatacgctgctcagacccgggctggcgctgcccatgccgctgctgtttgggctggcggctgtgtctacggaaatgaaagaggactcaggtttgactgcttctccatccctgtgggggccgctaagctggttatggggatgaggggccctgtggacagtgggctgggcctgggacagagttgggggcttccgggtcattgggcagccacgacatggttgggcagacaggccttctggctgggaaagacagcgaggtgggagtgggtgcaggactagaaatagatcgctccctcaatccccaaggaagccaggctggctgggagcagcaaagctccacacatgtactgtgcttaaaacagccttctgaggttcctgacctcattcagccctcacaatggaaggcatgattgcgccatttggcggatgagcaaactgaggtgggaacaaggggccctcagtgtccaaatctttcctgatatagcaaagcttgtttttcttctgcctttgacaaggataggagtggaagtggcaggcagaggccaccatcctaaaggtggctatcatcttcaccagcaggggaaagacgagaggaacaaggcggggtagaaaccctcccacacgccggggagtaggccagcccttgccctcccacagggctatctgggggatctaagtaaactcaacactctcaaggtggccactgagcaagagctcacaggtgtgtgtctcccaataccccaggctgggtgcatggtacccacctccccttaccctccctcagaaggtgctgcccccagggccccttccagctcccagtgctctctactttccccgatgcctggaggagcatgcggccacccggaggcagtgccacatgccaggctttccaggaggagccagggtggttgtgagatggggcagggctccagggaacacctaaaacccttagcaactcagccacctgctcctcactgctgccccaaggccctccgggggaaccatctggcctcaacacaagcagtcagaggccttgctccccacgggccgccccggcttggttttgcccaggcccttttccctgaaaccaatagcagagtgcacagtttgggtgagaagggggactggagaggtgcgcaagcactgaaaccccaggacattctgggatggcagtgatgtgggggcctgagacttaagaatacatcaagacaggctcagtgcagtagctcgtgactgtaatcctagctctttgggaggccgaggcgggcagatcacctgaggccaggagttcgagaccagcctggccaacatggtgaaaccctgtccctactaaaaatacaaaaattagctgggcaaggtggtgggtgcctgattctcctgtctcagctactcgggaggctgagggaggagaatcacttgaacccaggaggcggctgcagtgagccgagatcgtgccactgcactccagcctgggtgaaagagcaaaactccgtctcgaaaaaaaaaacaaaacacacgcacacacacacaaagaatacgtcaagccagaggcagaagattaccaacagatatacgctcctaataatacagagaaccagttagggaggaggaaaggaacagataaacctgttaagggcaagttaatttgtgtcctttctcgagggttatttatagtttcaagcagtggttctccaaatgtgccgtctgggccagcagaaccagcgccacctcggagcttgctagaaacttgaattctcaggcagttcacagccactgaatcagcagctctgggggagactccgcagtctggtttaactggcctctgggtgattctcgtgcatgttcaaatttgaggatctttgctttaaaggtaactggccagttggggggaaggctttaatcaaagcactgaaatcctctctaacagtgacatttatggtgccctactgggacagcaggaggggaagggggctccctgatccatctccagttaccctgtgagactgacccgcgcagcctccgtatgcagctggcatttgcttctgcaggtgggacaagggaaagaacccagtctggaagacacctccacttcggtagggccacagctagcccattcaatttcacacaactcagaaaatgacatcccttccccctggatagcatagcttgacgaatggagcctaggtagaatttcagcttcctctgcccaccctccttgtgcagtgcccaaccttcccagtgttacatggcagccctgcagcttcctgtggtggagaaaatgccagcaggagggaagggtgttccctttgatttcaactctcccattcaagggctcctttaagtgacaaggaaggaaaggtcagggtggggtggggtgggcagagaccaaggcggggctggggatgtgggggacagagggcagacctggaatcatttcaagtccttctgtgcaaacactcgtgtgtgctgtgggcccacattatttactcaggcagtgccaacagctcgctctgcccctgggccccaccctgcctggtgcccatgccctacccgctaggtggctccacccctggggacccccccccgcagccccccacccctccttcatcaccccctgcctgcctcctgccccgtccacatccccagagcccccatgcctgccacgttaggacagtctctgccaacaccctgggcgccatgccagggagacagaagcttttccaagaagcagaactcgcttcccttgtggccctcctgtttgcttggcctcagccacaggtaggacaggaggcagctgctgtgtttcaggcatggttgtgtggggtcggtggggatgaatgggcagggcaggtggcagcttttgccaggaaggcatataatgacacatccttgacacatttgctgagtgcatgtgaagccctcacatccatccccttgccaggagaaaggcagcacaggccttactctctctttttttgagataaggtctcgctctgtcgagtgcaggggcatgatcatggctcactgcagcctcgacctcctgggctcaagtgatcctcctgtttcaacctcccaagtagctgggactacaggtgtgtgccatcatgcctggctaatttttaaaatctgttgtagagacatggtctcactatgttgcccaggctggtctcgaactcctgggctcaagtgatccccctgcttcagcctcccaaactgctgggattataggcacaagctacctcatctggcccaggtcttattctcatccctactttgctaatggggaagtcaaggtgcagagaggtaaatccccaaatccaggtcttttgactcctggctcgggctccttcaccctctataccccacattccagcttgaccttgccctatacctaaatgccaaggaatctactccccaccaagcctcggtcctagctccaacacttccctgatgaaaaataagttaatggttaactgtgtggttggaggaaaggttcgactctctgcagatcaggggtggtggggaatgctccgtccccaaggcagcccaggcctagagtaggggggcttggcttactggtcaggcagccagggctggtgtgcccaacctgcaactaggcgtctcaaggttctgggctggcctcaggagggaagaagagagaacggcactgtgagcccctggcagtgagcaccagtgccacgcccaggctttcacccacatcacccgctttcctacccacagccagggtgacgtggactccagagccctgctttatagatgcggacagtgaggctcagggaggctgtgcagcttgtccagggttcttcctggccaggtgtgggttctgctcactggaccacattctctctgaggtgcatgctctggccagtcccatcttcctaggggatctgcccacctcctgactgggctccttgatgctctaaagtctgtccccacctcttggctcttcattccaccccactgttcatatccctgcagcaccctttcatcagacacccctgtgctcaagaatctcccatggctccccattgccccatcccagtggctggtgcctacctctgagtctacctcctacctggcccagataatcagagctggaaggggccatatattatgtgattgtttcatagaatgggaacaatgaagcccagagtggggaagggattcatgtgcttattagcagcagggtccggaccagaaccagggattgacatagtgaccacaaatccaagctctaatgagaatggcatttcatacctgcccctgtgctgtgggcacaacatggctattttctaagatgccctttccttctcatcacaattcatcccaaagccctcctgccccagcgagccctccctaatagctccctcctgcgacttcctaggctcgcctcatctgtgccatgcaattcagcccaggattaaatccatcagtgatggtccacccatggggacacatgtgcactggaaaagctcaggctcaaagagtggcagggaggtgcccacagtcacacagcacagccagggccagaccagaggcctcctgacactcaggccactgctccgtaggccaagggtcctgggacgtgccaggtgtctgccatgtccagggtcctcagatggcaggacccagcgttcctgcagccttggcctgccagtcccacgggctgccgtctcctgagcgatgcctccagctcccaaacctcgagttgatctcttctggattaagccacatgtctggattaaggctcagcgtgtcctggctccctcctgctccagaggccccagatcccactccagacaaagaaagtttggtaacagctggtggaggccaaggcccagagacaggagcagaatggtggggtggcggccagggggattagccaccttgggccccttctctcagcgccttccattcccccaggaaggaagattaaggaaagtgagcagagggacccaaaaggagagatttagtgcagcttttcctgccactaccctgcctactctcacccctcggggctagaaatgtgccccttgaaccctttgcctcccaggttttcactcccacaccccaactggcatcagcaaaagatgccctccctgacagctcccgaaccacagtttccgggaatggagtcacctgggaggcgtttgctaaggacccaggtcgctgtgcgggttggagcctgtcttccatatcctgcttggtcccggctctcaggccctacctcctggggagatggtggtgtggggtaaatgtatcctcacccctacctcaatcctgagacccaatgccagcccgcccagagcccaagaccccagctttagtccccattgagaagagcactgagggagtgacagagatggccactctggccctgctgctcagcccccagccggcctcactgcaggaggaagaggtctgatggggaacagacctcctctggctttcccatgtggcctactgagctgtctgtcagcccctccctccatccatccaagtccctgggtccccttaaatgggctggagtcaggggctgtggaggtgaggccaggtcttggccaggagccatgcagagtgggcaggggccacatgggcctgccctggtcagcaccttggagaaaagctgggctacccaggcctcaggaagtcccagccaaagccatgaccaggcccagccgcagtagcatgtctggcttctccaaacaccctgacccctgccctgccccatccccttggggccccagcctctctcttgccctgctgttcctcccaccccttctctgctcctccaacccttccacagggaggaccttgctgcaacctcacccttcaaactgctcttcaaactagctggacccaagagaagtgccagaccccttccttacggccctccattcactgcccagagcaccacttctgcccgctggacagaccaccccgctgcccaggaagggggcccaggctgccacctcgggccagcagctcctgccctctctcaagcaccccattgtggccatctccaagcacctgcttccccagggtctccaagggcagaagaagagagcagggaggtgactgagtgagagagatcttgctgtcttggactcagcatgagtagacgaggtgggtttcttctagatctccgggctttccccacctcctctgggcacaaaactgtccaggccaactgtccccctaacaacttcttcaggagccctgatctgtgtgagtttcaccttggggagccagctagtgggcccaggagctggggtctgttgggggaagtacaggggagtgggtgaggctttgtggggcgggaggcaggtggaagctgggggcggggccacgtagcaggaagacggggcactggaagccaaagtggagcgccaggggaacccagtggtttttctcttcccacagttcccacgggcagcaggaacacattgcatcagtgaagcctcctctgtgccctgctgcatgggcagcctgggtgtccacacacaccctcactggcactacttccagcgctttctgggacaggaggaaggtcaaactgaataaactgctttgccgggccctcccagctggggcagccagcattattcccacttgacggacaagggcgctgtgacctgctacggggcacctgtccatgcgtgagtgagcagggactcgaactcaagactcggctccaccctcctttctgctggtgctggcagacccggcatcttctagctcctaaggttgcccctgttgaccatcccctttgcctctgctcaggccacctgccaacccagccccacagcagttgccttagtggggtgtgggtagcacaggtgcccgcagcctggaggtacagaggcccaccgcagccccaagtggaccatcgtggctgagtttactccaaaaggggatgtggactggaaagaacgaagacctccacttcaggaggtgcaggtgacaccctgccctgttccctccataggagagaccctgggtgagtccctggtccctccagccctcagtctcctgctctgtaggccaggtcatctctgaggactttgttagccctggcactgcctggattttacgatccatgaccctcatcttgccatcagcctggctttggggacttaaagaaggatggtggggacgcagaggtggacacctggggctcccttgtaagcaaaggcatactccatttacagctgacacttttggcaggatgaggggtgtggctgtccctggagttgatgtctggaggctctgaaagactcagcccacccttctgaagaagcagagccagcttcaggctgtcctgcacctcaccagctgcccatcaggcctggctcccaccccagcagcagtgcctccccgcctcctccagccagcagggaccccagcccagacaaacctggggcttgcagtgagtcatgctgacggggcggggacagaacccagtttcccaccatagcaactacaattccgctcaaccttcagggctttccagaaattgccattcacgtcttccttcagccctggttgagcccatgtgtatataaatacatttcacttctcagtgcccccgtcaggcctcttagccacaccaaggctgccatacccccaccacctgcacatccccgctttgccatgatgcagcccgggtcacatggctgcccctctctggcacagtctcgtcctcacccccaaatcgccggtacactccttgaagggccggccacagtaccttccctcttccctaccctcctccagccccgcatacgccgtacctcccagcttgccacaggacaggggtcgtgaggtttcctgggtctcttgctccccacagccctgcccagcagggtcgttgagggcatgagaacacacggatgtcaccggagctctgctgctcctgcctgaggccccttggccgatcctcttggcctcagcctcttcagcagtgaaacagggactcataaagacagctgtgtgtctggattttgaagtcaccaggcaggacagcgatgtgagaaggcttcactgtctcccgagaggtgtgtgtccacagtggtgactgctgtctccatctgccgtgtttctgcggcccctccagacccagcacaggccagggaaggcagaggccctccacacacctggttgttggtctgtaaaatcttgatgggctgaagggaaaaaacattcctgcgccctgatcctcaggccctggagcacacctccaggcttggagaggggtgttaggacaaagtgaaggactccaacatcacagatgagaaaagtccagaaagaactgtcctgacaggctaagaacagaaattgcttcaaacaaggttgagatgggtgggagtgggttattaaggggttatcaggaccggttcccacctgtgaagtgtcagcagagacacatcccccttttgtcctggcacagagggtagggtggggcaggaggagctaggtcccagcagccctcaaagcaacttgctaccccaggagcagagaggcctgggccttgccccgcaaccagtctcaggcgctggagccccgggctgggcagtccctccagccacgtctcccctgtgccagagctagagggagaaggaggggggtctttatcctggtggtgcgccgtcataatcctggggaggtcccggtcccatccgacccccagcagagtcacactaaggtccctggctggggaggaaggatgagcctctccctccccaagtctggaggcccctttctacccacccccaaccccggctgctgagaggtgggagagcagaatctggcagggggcacctcccaggctgaaaacatgcaaactagccaggagaaggagcttggcattaaatgtcaggaagagcccagggcaactcggcttgtgcaaagtttgctttgggaagagttgttccacctgacaggccactcgcttggctgggggcacagggtggggcatgaacggggtgggggtggggaccaggggagggtcccagaaaaggtttgatccctgactctctgctctctagctctggggctggggccagtgactcagccccctctgaggctcatttttcttgtctgttaaatgggctgtcaagagtatgtcttaaaggggttgtggagattgagatggagggtgaatggaaatcatttatgatgggttgagtgtacatgaggggggccctgggcacaggtgaggggatcagctggagaagaggaaagagagagggaatggggtgaggaagccggggagcaaaggaagaagcggaaggtgatggggagtagagggagtgggcgagagagtggagtctggggggagctgaggatggtggtgagggaggctggggccctgtcctgttctctagcccagtccaggcagctgcaggcttcacccaccctccctgccctctaggaggaaccagaaccaagaattcctgccccacccacttccccccggcccccgcacccgccaccaccccccaacgcccaggagaccggctggcaaatccaactcctacacagccttcaaggtcctgctccaggctgtctcctccgtgaagcctgctttaacaggcaatagccttgtctaaccttgtttcacagacaaggtgttgcaagtacagtgaggaaaagtgacccgcccacggtcccacatggcgggacctcacctgttccttcttgccctccaccttgagggtctgtgtccccctgtcagactaaattaacttccccgggttatactcaggctgcaacaagtcatttagcacaaaactgctctaacggtttcagggctattcactttatactcacaacgacctcagtggtaaaaagtgggttctcccggtttttgcacttcctgccagcatcacactttctgagcatcgactgagcacctactgagtgcagccctattccctcagacttggttgacagagaagccctatcgaattcagagggtccttgtgaaaaccaaagtgttttacaactgacagtgtgcaataagcaagtctggtagttttcagctctggatacccccacggggcctcactcagaggaaatgcttgtacatgcactgtcagcctctcaaaggcgagggtgggtcccctacgcagtgagaccacctcctccacacagccccacctgcctgggagctccgagaatgccccccaccatttgtctgtgagtttggggtggtgggactccaagctgggggtccttggctctggcccctcttgcaggtgggtggagggaagctcagcccaactggcctggctgaaccatggcctgggcctgcccgtctggtggggcgtctcctccccatccctgcccaccagcttgggcctggggcagcctggacgcctgtttgctttgttactcagctgagcagctggtgatggggagatgcagctttattggggaggttgcggcaggaaatgaggcaagtcccagccctggccgaggaggaggagaaagcccatggccatcataaaggacacaggctacgcggggctcatggcctgggtgtgggctgctgggcggccccagctgataggtgaggtgagggatcttggcctgcccctccccaacatgcacacacacgcacacacacatgcacatgcaacacgcacgcgcacatgcacacaccacacacacacatacttccgcgcacacacacgcacgcacacacctccaccagcctcaggggcacccagtcgcccaggcccttcagcttcccaccctgtcatcccaccacccacttcctctctccaccgcagaaatctggcaaatcttagaaatgagcaccttcgaggtactgctactgttgctttccttgtgtgccaagaccaggacccaaggctctcagcttcccccagtgtccaagggctcagagtgtgtgctcagcggtgaccccagccccctggttcctgtgcccatccctgcccagcccagctactgggctctggacctgtctcccctgtcccgaactggacccggccttagacttagccctgacccatcaagctccagcaagcccctgcccactggtggcctggcaccagggagaccctttcctcagcagagcagctgggttggcagcagcagcaagccgcttgtgtttctccagccaagcagaactggctgggtctcaggggccggggctctgcatctgcacggcggcctcccctcaggctgggcagactgggctcagtgtgggggaccccaggccttgccgggcaagggggctcacccagcatgtagagttggcccagagaggcagtctggggagcatgaggagggggcaaggaattctgagggtaaagggatccaggtcacagggtcactgatgactgggagatgagctctgagctggcaaagtgcgccccctccaagtcctgcctgcagtcgcccaccccccagctggcagggaaagaccccatgccagggtacccccacctcctgttggactcacctgttagctgcctggtgcccagggagctgtctgctgcagtgccaacttcaggggccgggaagaggtgtgggcagctgaggccactggcgtgtctcagccaggcatctggggggccagcggaaccaggggccagcagggctggtggcagaggcagcactcaggttggccactgggggcctggccaccctcaaggggtggccctctgaggtctcagggctgcgtgcctgtagggagtcccctacccccagcccagggctgcctgctggcaccgtggcaaggcccaacctgaggggcttgcagggagctggcagcaggcttggaggactgggtctgtggggcagtgtggacacggcagagtgcaggaatgtgctgggaggaagtcagacagccgcgagatgaagagttggccagggcctgatttcccattataagtaatccttccttatttacctgaacaaatacactccttgcttacctcagaccacaggcaggctcctgattaacccttgcaggtctccccctccttgctgggggatccatgccctgacagctaggggactcattcattcactcgctcattcactcgttcattggttgctgcatagccactcagctcatattacgtgcaaggcgccagagatacgtcgagtgggtccagggctggggttctaagatggatcagctgagggccagagacagacaagtgagcagcagtggagatccagaaccacccatgcccagatggaggactgagggggcactgagggtgggcaccaactagggaaatcagtgagggcttcctggaggaggtgctgtctggctactcaggccagggatggagagagcttcagagaaccctggggagggatcccgaggcttgtgggccaaccacgacctggtgggaactgtgttctctgtgccccacagggtcctcatgcagacctgtcacacagtggcggtgaggaaggactcctagctcgctttcccaggcccgtaatcgggggccagccagcagcaacttgctctcccatagccccaaagggtgatggcagggatgccacgcaggacagaggtacccaccaccaagcacttgctgccccagaccctccacctccttgagccctgcgggggccacacagtccagcttttggcttcctccatgtcctgccaggtgggctgagagttgtccctggaggctgggccttcctttctccaaatcatctcagaagggctccacgtacctgctacctccattctgacgggagaaagttctagataatgctgatttttctcttgtttcaggagtaactgtgtaactgccgagagcatgaggattctggggctgcaggggatcccaaggcctttagaactagcccctcaccttcaccaatacccacattctccaacgtaaggttgcactttgcacccccagggagccctgtacttggctgttatcgtcactggcaccttggttgaggatcagttatcagtcattccccagagaaggttgagggaggatggagcggaggaaggggaggtaacacaaggtcctgaaatggtacactcgaccactcctaatccccaatggtccagccctccagggtcaataaagaaagacacgctgcgtttccaggtggatctccttcccctagagtgcgtttttgtgcctgcttctctggtggccacgcctccctcctccccactctcacagaagcctggcttatatcacagcattctgatgcattaatactaatgaccactgcttaacaggcacctactgtatgcctgtatgttcgatgctcatgagatgctaagctattaatcatactgtaagtactataatgtgggtaagtacaaggaatatctaataaatgtttattgaggctgggtgcggtggctcacgcctgtaatcctaacactttaggaggccaaggtgggcagatcacttgagatcaggagttcaaaaccagcctgggcaacgtggtgaaaccccgtctctactaaacatacaaaaaattagctgggcgtggtggcaggcacctgtaatcccagctacttgggaggctgaagcaggagaatcgcttgaacccaggaggcagaggttgcagtgagccaagatcgtgccactgtactctagcctgggcaatagagcgaagctcaaaaaaaaaatgtttattgagtggataaggtgtcaaagatagctgtccattctccccttttcctcagtaaacaaggcttgatttttattttttattttatttatttttgtagagacagggtctctctatgttgcccagggtggtctcgaactcctggcctcaagcaatccttgtacctcggcctcctaaagtgctggaattacaagcatgagccactgtacctggccaaggcctggtttttagctgcgcacgtggctacctagaattaagactatcccagcctcccttgcagctagatgtgactatatgacaaagcagaagtgtcatgtgccaagatttctaggaatctttcttaaaagtaagctggcatgtaccattaactccattcttatttatccttcctccatcttgctgggtggaatgcagctgtgatagctggcattctggctgccatcttagaccatgaggacaagatagtagagtaggcagcaagctagaaggagcctgggtctctcaggattatgtaaaacctccataccagctgcagactgcctgccttaggacttttatgagagaaatggacttttcacttttgttaagtgggaattcttactggtgtggcctcactcaaggcccaagggagcatttcacaggggtctcctgaatggatgggcccagctaaactgtactggctgtggacagggtctctacccatttaagcctggagtagggaaacaaatgttgcctctggaagctggaaaaggtccaccaagagggagcaagggagggctcccccatctgctcagctgggctcacacaggcccagcctccaagaggctgcttggggtggacatcagtggtgtgcccaaggtgggttggatgcccatctaaggcaatgctggtgggcttcaggggaggaaaggccaactttcccaataagggaactctgggtgacacacatcctcttgaccccctgatccaccgggcatggtgtcttggcaccagcttgggatttgatcaagtacatgtcctgattctgtaattttccagctttgtgactttaggcaagtgtctgaaatctgctgaacagtcacctcccaaatccagagaaccctgagagttactgtgaggagggagaaaatgctggtcaaagtgttccatgaacctggttgccctattccagggccttgctgaccaccaacctggccacgtgtttgacaaatgccatcttactcctcacagcaacactcacaggtagatgttgctatgcccatttctcttttcttttcttttctttttttttaagacagagtcttgctctgtcacccaggctggagtgcagtggcgcagtctcagctcactgccacctctgcctcccgggttcaagtgattctcttacctcagcctctcgagtagctgggattacaggcacgcaccaccacgcccggctaatttttgtatttttagtagagacggggtttcgccatgttgaccaggctggtcttgagctcatgacctcaagctatccacctgcctcggcctccaaaaacgtgagccactgggccaggtatatgcccatttttcaagtgaagaaattcaggcttgtacatttaaaatgtcatgcccaaggtcacagctgggaagcagattcaaactcaaatccctaatttccatgactgccccatgcccagtaaaaccctattgctactctcacgtcctctcagggccaagtcccgggtccctggaacaggtcactgggtccactagacttcctgcctccagctccctgggctggactcctctctaatcctcctctggccagctctcatcaggttaaatgtgccccctcctgtttgccctccatccagaccccacccatctgttgtgggcgatgcctgctccatgtccaccccttccagatctggggtctagtacacaaccccagttggctcagtgtgactctgtcctggaacttttctccagcctactgagataacaaattatctcttgccactagagtttccaagccttgacgtgttaagtcaggagctgctacccccagggagaatagggacagcccagaagaggaggagccagacgccctcctgacatcgccgtgggaacacctggatgaagctgccattccctttttctgtcgttcaaatggacttgagtccctcctattttggtggagagaacccccatccttcggaggcccatttcaagagccctctcctccagaaagcctttccctgtcccctccagtccttgcggacctcacatgtcccaagtctttgttctctaattctttccccactatttcttatttctttcttcccaagattttaactccttgaaggcagggattctagagcagctggcagcatcagacccaacacaccaatttctggagcagttggcctgagcttcctccccacattggtcctctctggccactggcccaccagaggcaagcgtggagagcaccgggtggaactcagggcccacatctcggtttctgtgcagcactgccactgacgagcggcgggatcacgagcgagtctcaagcactctgggcctccctcgcctcctctgtgaatggcgataacaacgcttgccctgctgaccttgtgggtggagcactgtgatgagcgaatgtcaagtggcagcggaagtggacacgctttggaaagggcagtctgtctgagtcagtctgttggtcagattcctgccttcctagctttctttctgactccatctgcctgcgctcccatcctcactgcgtcctgctctctgatgagctagactggggatggtggcagaggcaaggctgggatgtatgccagccacagggacatgcagctgccagttagttcccgactgacacaaggccccacccccagacccaggctccagctgcgaaaaggctggacagcttgggggagggtgccccctgctgaggcgtgaagagcctgaggctggtcacctggacagggccagaggggacaggaagggcaggacacttggttggtgggatcccagaaaccacccagccatctcgtggtacaaagaccttgggaccagagaggctagggaccaggcccaaggacacacagcagggctgggatctgaatccagaccccgatctgtgctcccacatggcatgtgttatctcattcaatcctagcaagtccacagggggtcattgcctgtctcactcacagatagggaaaagaggctcactgacattcccagtcaagcctggataatggcagaggaaggattcaggctggatctgttggaatcctctctccaggacaccatgttgcagctggatggtgaacaaggggctgggaaatagcccagggggtggtggctgtgttctcagggccatactacgaggcacttccagcaactgcagcatgccagggcccctcttgggcacacttgggccacaacacgttgctctgcccagaccagcatcttactctgtgctgccaggccctaaacgggcactgaggccagggtggccgggcacaggggctgggcacagcctgctcttgaggatagttcaaggcctggtggccacaattgctcagggtcttcttgcctcagagggcagtgatgactcccaagggtagccatctgtgggcttactagtttcatgaacacctattagatgctgtcacagtgagtgaccctctccattctagggaaaaacaaaaggtggaagagcttcaggcctcgttccatcagtgccatctcctacccctctacaaactgactcctcagagaatgaccccaagctcctgatgggggccgagcaaatggaccccaagctcgtgatgggggctgagcaaatggaccgtttcttcctgtagccaagggctagctgtacccacccccattgctgattcataactgggaggccatctgaagaggcctcatcctatcccagggccccagcccttggggtcctcagagttcccatgtggacccagccaggcagggctcgtgccagagttaggcaacaagcctgagaaccctgcagccctagcttgggggacagacaggacacacagatggcatcctctttaccacctccaccccgtgatggggagcagggtggcctgcgcctgcccgcatgaatccattccctccacaggaatgtgctggagggctactgcgggtcaggcacgggtcattgcatacagcagagcctcattgggcttacattctaaaggaccagcaacagcaaaggtgcaaatgagtaaattgcatagtacactggtgggtgatgcatgcatgacaggaagggcctaggaagcctggagcggtgggtggggtgtgggagcagcactgaatacggtggtcagggcagatccctttggggaggtgggatttgagcaaggcacgaaggaggcgagggtgtgagctctgcaggtctctgtgtgcattccgggtggcgggaggtgacatgaggaggcactgtggagttagattgtgggggccttgaagccctggccgctcatttcccgggtcccctggccaagcatctcacctctcccatgctcactgggagccaagtgccatgctggttgcttcagaacagttagctcatttaattatcttaacggccctttgaggtagcacccctatcgttagcatccctattttaacctcagggaggaaactgaggcacggggcgggagaggagcttagtactttgcacaatgaggggaggagccaggatctggtgcaaagccccactcttagccaccactgcttatggtctggtgtgtctgctgcccctccctgacccgcccccccacagagcaccaggtgcacccccagcccggcaggcccgtcgtggggggtggaggggccccacatcactgctcacaccctagagctgaccgctgcctttccccgattaatgcagagccagccgggccttacaaaaccgcaggcccagataagagcacaatcggaacctgttttgctcacaggccagctcaggagctgggccctccggttggtgggaagttcggggggaggctgctggcagcactctggccctgttatcagtagccttctccccccacccattagcccctttgaaatttacccatcttatcagaggttcgagctttccagcttttggagggagagctgttatgcctttgtgtccagccgctgccttctgcctctgcccagagaagactacgtctgagggtagggagggtagtggggtggaaggggtagggacttgtaggggtgaagggcctggccctccaacccctaagggggcccctgcagtcacacacatggacctcggcagccccatcactgcctgggcacttcctgggcactccttccctccttgccctgaacagtgcacactcaccctaagcctgcagcacccccaactctcatccttctcttagccaagcggtgagcacagcttcctcccactcctcatgaccctgtccagcttgctcagaaactcaggcctgatcctggcaccccccaacccccgtcacaccttcagcaaatgtttattgagcacctactacactccaggcgggggggcacggcagtgaacaggacagaccaatctcgctgtcccttggagctgacgtgctagtgctggaaacagggtaaataaacacaaataagtggatatagtatgtcgggaggtgggagctgctgcagtggggccagaatgaagcaggaaaggagcatggaaagtgttgagggcaattttaagtgtgttgggtggagcgtgggggtggcatttgttttgttttgttttttgagacagagtcttgctctgttgcccaggctggactacagtggcgccatctcaatctcagttcaccgcagcctccgcctcctgggttcaagcgattctcctgcctcaggctcctgagtacctgggattacaggggcccgccaccacgcccagctaagccaccacgcccagttaatttttttttgtatttttagtagagatggggttttaccatgttggccaggctggtctcaagctcctgacctcaggtgatccacctgcctcccagagtgctggaattacaggcgtgagccaccgcgctggccttcaggtgacatttgattcaagacccaaaggaatctagccctgtcccactgtggagttagaatcacaaacacaggagggaagagccaagagatggagatccaccagtctaacatgcttccttttttcttttttcactgaggctcagagagtgcagtgagctgcccgaggccacacagcatgatggcagcagagccaagcaggagttagagcccaggatttcggtggcccaaacaggactcttccccctattcctgctgcccccaggctggggcagtgccagggccctgggcaagacagttctggctgtttcaggatgaggggtgagggaactgagcatggggatgcaaatgtccacagccatttgactgccttttgcagcctagtggggtgggcaggacttgtttggagctgagagttggggctcaggtgctggtgcagggactgcagagtgtaaatggatggcgttatgacctgggaggcctggcttcagcaccccagccccctcagagtctcagcagcccctgcccggtgtcagtcctttgtgcccctcacttctagtccaccagtggcctgacctcgagggcttgttcttccaggagaagctcctttctatggccccttcctcctgtctcccaccctctcactcccaacatgcacctgccctcctgtgaagggagaagtggcctggaggggagaagggagcagtcttgggcatggtggagggtggggtcatgagccaggatggatgggcactccccaggggcctggctcctgctggatgagctttaaggagacagatgagaagtgggtgctaaagggagctcgctactgggctgctgtgcgtgctgtcgcctctgggccctggggaggtggcggtgttcagaggccctcaggacaatgttcctattgagatggagaagcctaaggcagttaggctgttggggaaagagcactgagtctggagactgagttcaaatcccagttctgctgcgttcttgctgagtgtcctcgggcaagtcacttcccctctcagccttagtctcctttcttggtgaaagaggatcaaggatcccttcttcaaagggatactgtaaggagggaatgaggagaagcacagcgcctgtcacacagccaggactctgtcaacagcgggctctctcccctcagggacctccgtctcaccctcacttgattatggccagagtttagggccatgcggactggcactcagcaggtgacaagaacttcggaggcttttttcaggaccttgggtgcacactggattaaccataacccttggtttatgacacaccctccccaggatccacatgtggacacctcttaatttttaataatataatgaatactgggaacccactggcaacccaagatgatgatgattaccagtaatgtcacatgtatcaactcacttatttttcttctcagtcatatagttttgtgtctacactgtcaccattttacagaagaggaaattgaggcataattgagcgtttggggcatcctctctgggggacgatgctgagatgcactgggtacactcttcccaccaactcctcctgctctgggctccaggcaaacagaaccctgagggatgacatcatcatatgacctccactgcgtcctgccatgttctgtagccccttcaaatcccagccagcccctctccccgtgcagggccccaccttccacaacactgacccctagggtgagggggcctcagggaggagcctgcctggccctgtgctccctgcctgcctgggcctgccctggctcctctcagccccccggtgacctcccaaccctgctcagtgacacaagagcttggtgctcctaacactctcatgtcttccttctaggtggcgcccaagaataaatgaaagtaataaatgaggggccaggtgtggcagctcacgcctgtaatcccagcactttgggaggctgaagcagggggatagcttgaggccaagagtttgatacccgcttgggcaacattgtgagactctgatctctacataaaattaaaaaataaattagctgaatgtggtggcctgggtccccgctactctggaggctgaggtggtaggatcatttgagtccaggaggttgaggctgtagtgagctatgatcactacagagcaagaccctatctcaaaaaagaaagaaagaaaaagaaaggaagaaaggaggaggaaaggaaagaaagaagggagggagggagggaaagaaacaaaacaaatcaaattaatgaacaaatgagccaggagcggtggctcacgtctgtaatcccggcactttgggaggccaaggcagacagatcacatgaggccaggagtttgagaccagcctggccaacatggtgaaaccccatctctactaaaaatataaaaattaggcaggcgtggtggtgcgtgcctgtaatcccagctactcaggaggctgaagcatgaaagctgcttgaacccaggaggcggaggttgcagtgagcaaagatcatgccactgcactccagcctgggtgacagagtgagatcctgtcttaaataataaacaaacaaacaaacaaacaaacgaatgaggatggtggaagggggaaagggacattaaaggagaaaaatcactgcgtggctctgagcactggggtgggcaatgaaggaaggtgggactcagtgttgaaagacgcccctctgccagctgccacactcagggagcatctgtgcccctttggttgtgttggtctgacccactgatcctactgcccttgccctgtccctggcctgagacctgcccttcccccacggcgacttcccagacagagagacagccagagttcccaggcaccatcctaagccgatacaactaaagctgccccacagggcctgggctgggcatcgcctgctgctgggaatggggtagggttggggtccacacgcaatgccagggaaagcaacctcttccccacacatgcgggtcttgacctgtatgggtgggtgctggtcacttcagaatctgcttaaaagctatggaacctcagaacacacatacacacacacacacatgcaatcccagggactcacagactgcccccccgcccagccgaagcacctccacaaaccccagattcagagtccccgtcctggattgtgggtaatgtgtgggcaggactgttggcctcacctccagctcacagcacaacaatggcatgccgtaggtgtttactatgtgcctatttcaacaaatcaacagataccgacttgttggatgaaggaaaggacaactgggaggatcatgcgctggatcaagtcacagtcaggggaagggaatggagggtgaggtgggggctgcccctctgctaaccatctcccatggctcccgctgccccgtgagaaagcacgaggagtctgtggggcgggaaggcctcgtgatcctgccccagtcgcccgttttgcttcactttacaaccatgtgtgttggttcagccctagaggctgccagcagctctcgccaaacatttacttattctaacatttactgagatgttctaggcactggggatacaaccatcaacaaaacaggccctgccatcatagcgctgacagcggctcttgcttccagactttttttttttttttttttttttgagacggaatcttgctcttgtcgcccaggctggagtgccgtggtgcgatctcagctcactgtaacctccgcctcccggctttaagccgttctcctgcctcagcctcccaagtagctgggattacaggcacgcgccaccaagcccggctaactattgtatttttttttagtagagacgggatttcaccatgttggccaggctggtctcaaactcctgacctcaagtgatccacccgcctcggcctcccaaagttctgggattacaggcgtgagtcactgcgcccagccatatccggcattatgaaacagtcctccttgtctgatggcctcctgatctgggagcccacagggacagggttctttctcacgtgcctggcatccttggaccccagtgcagtgcctggcagatagctgtgcgtggactgaaggaatgaacaggatggatggactttgctggggccgggggtaccaatggtgaagcaggaggtgagtcaaggctggggctgaggtgggtctgaaaatgtccctgaggaaggcagagggtgtggggctaggttcccatgtaagatctgattgccttgggcaacaatggccacaggcttgtgggaaggaggaggatcggggaggggtgacggggaataggatttgcttcctggtgcggggtttctagccacttccacctcaccctggggttccagtcaggggcaccactcccctgaagtgactcaagccttgtggagtaggaggggcaaaggggaggagggtgatgcagaccacccaagtcaggccctggggctgggggacactgagctcttacctccctgggtggtgactcctatcaccagctccacaggaggggctgagacacggcctgccctgtgctcggaccccaagacagactcagagagagtaaggggtctgcctgaagtcacacagcagggtcagggcttgacttatagactcttttcattcccaggcagcacctgcccagctctacggggccagggagggggagacagtttctctgagggtcccccctcctaagggaggggcaagccaggcctgcctgtgagggcaccaccccacttgcagatgagcaggggcctggcccagctgtgaggacagagggtactagtggaagcaggaacaggacggaacgctggtaagaggaaatccatcacctctcctctccctctcccaaccctactgtcccaaccgtacgaccgacacccactacccagctccttcaccaccagggaagcctccctccttcagctgccatccttaaggaggggaaaggagacagggagagggaggacagagactgcgggggaccctgtcctcaggcatgtgggaactgtaaaaataggagggggcgtgtgcacccagtgtgactcccctccccagaactatggacctcagagcccggaggggcctcaggctgaacctgtctaatgattcattttacagggatgtggtggaggcccagagaggacagaagcttgctcaaggtcacacagcactgtgtctgttgaacctatggagtgttttctttgtacaaggtactcttccacgtgcttcacacatactaactccagaattctccccacaaccctatgaggcaggtgcactactatgatccctattctacagatggggacactttgaggcacagagaggttaaggaggttgcctgaggtaacacagcttgtgagtggggcagagctatatgggagcccaggcagcctggctccagagcctcgtgcacaaccccatgctttgttgcctctagctggagtcaccaagtaggagtcttggtctcgccttgacttctgcctgctgagtgccttcaatttggtctttcatgatctgtgtctttattaatgtaataataatattactatttgaatttatcgaaccctttctgtggtgcaggcactgtggactcatgcttttctacatattacttctcataataaccctatagggtaggtatcatactcccatctgcagatgaggaaacaggcccagagaggttcattaacttgctcagggacacacagctaataagaaacagccagaactcgaggccagccaggccatgactctgtcctgcccatacaggggccaacttgaatgaggggtcccagggtcagtcggccccaggaaggttgttctgtccagacattttctccacttttggagatctcttgccatctgtgcccttcatttgacccagcagtcctgcgtgaccacagaagctgcccccaccagcccctgccggctggtgacccttaaactcttctgccctcttgacacggcttttgcgtcatgtcagagaagccaggatccccgcgcccagtctgggacgcagttggcagcagctgcaggaagcatgacccgcccagcatctcgggtgtcactcacgaacctcccaggtgtcgctactggcaggtgaggaaacctcacacagcaccccaccctcctccttcaccccctcgctccctcactcacatagtcattcgttacttccttttatttatttatttatttttgagctcgggtctcactcagccacccaggctggagttcaggggtgcgatcatagctcactgtagcctccaactcaagcgatctaacgatcctcccccctcagcctcccaagtaaccaggaccatgggtacacatacgtggctagttaaaaaaagtttttttttttggtttggtggagttggggtcgtgctacattgcccaggctggttttgaactcctgcaccagcctcccaagtagctgggactgcagtgtgagccaccatgaccttgggagctcaaggtctgactagggagctgagaacagcacctggcacccggcaagtgtcagggaaacagggacagggatagacaggaagaactccaggagtaggaagaggagccacggtggggttctgagaggctggcaggctgggagccgggctgtaaagactgggccaagccttggagaggtgtgaggaaggggaaggaaacaagcatgtgctgagcgttctgtgcagtgtttctcacctgtgaggcacatacatgaatgaggcagggtggacagacaacttctgtgacctcaggagagccccttcatctccccaggctcagtttcctcaggcacagagacaacaacagtgctgacctcttaggttgaagatcaacctttgcacgaacacatggacagcagagaacacatagtgagtgctgtgagggctggggaggccttgtatagcctgccgagttctcacaacaacccttttttttttttttttttttgagacggagtcttgctctgtcacccaggccggagggcagtggcacgatctcagctcactgcaacctctgcctcagcctcctgagtagctgggattacaggtgcaccaccacgcccagctaatttttctatttttaatagagacagggatgttggccaggctggtcttgaactcctgatctcgtgatccatccacctcggcctccaaaagtgctgggatcacaggcatgagccactgcgcccggctgtacgacccacttagagacagaaaaatggaggcagggcaggggctgtgcagtagcagaactgattggcctgcttgaccaggcgtcctagagcatttggggccagagtgggtgggaagtctggggatcagagtgtggtagggctggagacctcgcagtccaacagcctgccccaggggggttgaaacctggctttggccccagctctgcctccaacttgctgtgcaacgtcaagctcctttccctcttcggtgtcagcctggtcttctaaaggccaagaggctgtgttagacagtctgtcattaggtccctgattggcgctcccggcacatgcacacaggtgccccccactgtgggaaagcccccacctgcccctcgcaatctactgtctatcactgtcccctgcagcactgtcacatcgggcaggctggacaggctctttacatacgttgtctcatttcatctgcacacaccgttgtgagggaggtctcatttctcacttaccgatgaggaaactgagaccccgagaaggtaaatgggcagccaaggcccccagagaacaggtgagtaggcagaatgaggggccaaaatctccatgcccttgcctctcccagggtaggcggccccctggcctagtagagaccatggctggcttgtccttcagcccccacagcgggagggaggtttcagaacgggctgcctctcactctgccggtcacccacacacctgccagagctgctccacctggctgggatctggggcctctcggcgccgtctttccctgggtcagccttttcccacgacggggctgcgcgagtgcatcccgagttgcagcagccgtctcctctgcactgctccatcagcgagcttttctgggctcctccaaggagcatgagccctgccttctgggaggccccattctctctaggtgaacatcaacctcgcatcgatcccaggtggtggatgctccctcactttacaggtgaggaaactgaggcaaaggggcatttctgttacctcttgggtggcacagcacaaaagcagagtggagaaccacgtgctcgactctctcccaacccacatgaaacaaaggaaaacaacagcagacagaagggaacttgtacaggacagaccctccacaccagaggaaagcagaacacaaagggagaagaaagcccgagtccctgggactgaggtgtgggcagggggtgatcaggctgaggcacaggtctcctgggacaggcttttgatccgctgcaggtcctaccgcacagggggcaggcactgtacccagcccacctccaaccccctcaccaaccctgttgttcccattgcacagatgggaaaactgaggcccaagctccatcctgcagggccctcggaacagaagggtgaggtgtatctggctgaagggacaagtgagttcctggcaagccaagaggaggggacatgggccctccaggcttcctgcccttgcccaccgcaggaaggattagccccctcactcacacagtagcgggaggcagtgagaggacagaaggccacccttcagctggggcctcccaaagcatcctttcaaccctcacagccagccaaggaaggggctgccaagtgcttatccccatttcagagggaaaaactcaagctcagagagattgacctgcccaaggttgcacagctgattggaagtgggtcagtttgcctctccagaagagaaggaggaccagagaactgaaaggagagacaggaaggaggccgggcgcggtggcttacgcctgtaatcccagcactttgggaggccgaggcgggtggatcacgaggtcaggagatcgagaccacggtgaaaccccgtctctactaaaaaatacaaaaaaattagccgggcacggtggcaggtgcctgtagtcccagctacttaggaggctgaggcaggagaatggcgtgaacccgggtggcaaagcttgcagtgagccaagatcgcgccactgcactccagcctgggcgacagagagagactccgtctcagaaaaaaaaaagaaaaaaaaaaaaaaaagaagagagaggaaggaggatgaggaagagaaaggcaagagggtggccgaggtctcaagacctcccagctctcccagttccctgcccagactggcttccctccccattcccagaaaggaggagcccgctctgaactgctgcccctcacacctgtccccaggaatgaggcatccttcaaggggaacgtgctactgtggtctccggcagggtgtggcctcctgggaggggctgtttgttcccgggtaggccaggtttggggatggctttatggtgccatctggaagatgaggcctgggcgggcctagctggcatagggccaggacagggaagggggtaccaggcacagtggggagctgccccctcacccccgagctgttgcttggcccccagaggagggcgggggcttcagtgagcctgagtccagcatagtgtgaccctgtgaagcaggaagtagctccatttcatgggtaagaacactgaggcccagcagatcagcaaactgcccaagttcatacctggccagcaggtatgaactcaggccaggtataagtgacattagagcctatgtcctacccacctctcagcactgccatacatgggtgatgagggcaaagggcaggtctggggcagaggacctagcccagacaccctgaaacctggagcagggtctcaagctccttggcactcggtttcctgtactgtaaatgggggataatatactactccttctggacagatgagagaaaagtggagattgtatttgtgcacactctcagaaggatagacagtagtcccagggacggatgtgagggtgtgagagagggctgctggtttttatcatggggatgtgtatgatacccccacaacactcactgctgccacaggacaaagtcctcaaccgatatcgatgacccttggctgcaggatccaaccccaacccccacagccactgcccctttcccgaggcagggacagggggttgagcaagttacctcccgtctctgagtcttagtcttctcaagggtcaggtggtgatgaacgttctctatagactgtccgtgtgaagctccagggagctcctgcctgagaacacgcatggcctgtgcaggtgaggcattaatacgtaataacagcatcaacaccttcaacactgagttcattccatcttcttaagggcctcagaggtactgtgtccagagacaaggtcgggagctgcaggacttgcaggaggagagaattcagggagccggccagtgtccttccttcctcagcaccctgggcatcgttctccaccaagaaggatgctcagggcatagcggctgtgccctggtggtgaaagggctgcttgtcccacataatcagtttgggtttagggctggtttccctccaagcccagacagctgccaggaggatctgtcccgggcacggaatgttggggtgtggggcgccctgcctgccttccccattagatcttggagtttaccactcatctgcacacccagggcccagcccactagggaaaactgtgaagggggccatagtcctggacccttggcatttgctgggtctctggacccagcagctcctctgagcaatcccggtactagggcaggactcccccacaccctgggatctctcctctcttctccaggcttgggctgggccccaggctgagggcctcagtccctgacatctgagtgttccatctgagctgtgatctgaggggtcctcccctgccccttgagggtctacagccctgggtttccgggcccctttcctgagggctaccttcagtacacatttcccgagtgctgactgcacacctggtgctccctagccacctgctttatctctcccatgctaagctgttcatcttcttggcaccaagagcctgaaatgatctttaggtttggtctgtgcaatgcctgtctctcccccatcagaatgtcagcaccttgggggcagggactgggcctggctcattcactgttgtctccagctgtgggcagcagtgcccctcaaatcagcttcctagagaatccatacctgcttccggtccctgctgagtagggagagtgggggcggtggcaaggccccacccctccgcccccctctgggggataccataggttggtgttctgagttctccaatctcctcctttcacctgagcaaccctggggagtttctgttactggcaaccccagcaggttagataatgagctatgggctccttacctagctggggtggggtgagggtagagggccccagaggtggagaaaacagcatgagttttatttttgcttgtttttttgagaccgagtcttgctctgtcgcccaggctggagtgcaatggcgcgatctcagctcattgcaacctctgcctcctgggttcaagctattctacctcatcctcccgagtagctgggattacaggcatgcaccaccatgcctggctaattttgtatttttagtagagacagagtttctccatgttggtcaggctggatgtgaacttccaacctcaggtgatccacccacctcagcctcccaaagtgctgggattacaggcatgagccactgtgcccggccagcatgcactggttttttgtttttttttttttttccccaccagaaacacgtgcactttattgaatgccattgtagaaaagtgcgtgaagataaagggctgatacaggactgggctccgggggcagggcgaggtggagtatgtgggattcaggtcatgggcagagctcctggcctggatgatgcctcctgatctatcgataggcttggaagatcaacacccggatgatgatgagcagaatggtcatgaggatgtccacaatcagggctcagatgttcaggcacttggcggtggaggcatacgcctgggccccagtcaggtcaccaaccatcttcctgtccctagacttcacggaataagcaaatgctatgaagcccaggcagcaggggttcacgaagagggtgttgaacagggatcagacgacacggtcgggcacggaggtctcgctgcggctgtggatcatggtggatgtcggggagcagggttgtggggtgccctcagcacagccacctcgtgctcctccttgagcatctcatagttgggggggatggccgctgttgacaggagaggagaaggtttggacagtgtggttcatggtgtccagcgaagaccagcggtggtcgggttactcggatggttctcagtgggccctccctttccccagtagtttcgttttctcaacagtttcctcttcctggcatttgtccagcatgcagtttttaagatcagagatggaagagtacagggcatgtgtagggaagagagtgctagttgcctccccagtatctgttttcttctactttaaaaaattatttatttttttagaaatggggtcttgctccattacccaggctggagtgcagtggcaccatcatggctcactgcagcctctaactcctgggctccagtgagcctcccgcctcagcctcctgagtagctggtactacaggcatgtgtcatcccgtccagctaatttttaaatttttattagggatgaggtcttgctatgttgcccaggctggtctcaaactcctggattccagtgatccttcctcctcagcctcccaaatgctaggataacaggtgtcagccaccacacccggcctccttttatggatataataatgacagcatttcttgcagatggaaggaacaagcagccaagttctggcccatgggatatacatgaaagtcatcaggtggggattctaagacagttccttataaaggggctgattcagtctttcttctgtgtctggaatgcggatgtgatgtctggagctgcagtagctgtcttaaggatggaagccagccctgtacataccctcagactttatatctaatgagggaaaaataaatccctatcttgtctaagccactattgctcaggaccatgctacttgcagctgaatgcaattcccaagtgactcaagagggtctgtcaggccgggcgtggtggctcatgcctgtaatcccagcactttgggaggctgaggcgggcggatcacaaggtcaggagatcgagaccatcctggctaacatggtgaaatcctgtctctactaaaaatacagaaagttagctgggcgtgttggtgggtgcctgtagtcccagctactcgggaggctgagacaggagaatggtgtgaacccaggaggcggagcttgcagtgagccgagatagcgccactgcactcaagcctgggcgacagagcgagactctgtctcaaaaaaaaaaaaaaaaaaaaaaaaaaaagagggtctgtcagtatctccttctttgccctctcctttgctaagatggtcttaggtgactatttctccttaagggaggcttctgagaagcaaagtgaacaaagggaagggaagtggctgagatatggagccaacccttatgaggagatcaggagtacttaggagagaggtcctccagagatgacccaggcctcccacttgagtgtacaggaagggtggagggaccccagactcagctgtcatccactattcccctcaaaaatgaatttgcagatgaacatgtaacatacgaggcacagtcagatctccagtaatgttacttatcctcccaagtacacatagccaatatttgaaaatgcttggcgggatgtggtggctcaaacctgtaatcccagcactttggcaggcagaggcaggtggatcgcctgaggtcagcagtacaagaccagcctggccaacatggcaaaacgcggtctctactaaaaatacaaaaaattagctggatgtggtggcgcatgcctgtaatcccagctacttgggagactgaggcaggagaatcacttgaacccaggaggcggaggttgcagtgagccgcgatcacgccactgcactccagcctgggtgacagagcaagactccagctcaaaaaaaaaaaaaaaaagaaaagaaaaaagaaaatgctcaaaggtccataaaccatgccagagtttcccctattgccacccttgggttagagccctggactgatgctgtggcagccctggggtgagggtgaccaggccagaggcattgctgtggaactgtcaggccctgtgaccagaccacagaggtggtctgtggctccccacctctggggagggatggccacagaggctcccccgctggtaaggacaggcctgcgaggacagagagggctcaggtggacagggcagctctttatctaaacctcatatcatgtgggtgaagagacggcccagagagggtgagtggctccttcaaagtcacacagcactaaaggcaggacaggtgccagaatctgtataaaatccatagttggcatctgaatacaatggacacctgcttttttgctttgttttggctgttcttcttgcctgaaatgctcttctcccagatatccacgatggtcgctaccctcagctgcttcacacaccacctcaaacatcaccttctcagtgaggacctccctgacctctcatttaaagttgcactcccagccagatgtggtggctcactcctgtaatctcagcactttgggaagccgaggtgggaggattgcttgaggctaagagttcaagagcaatctggccaacacagtgagaccccaactctgtttttattttttaaattttattattttttgagatggagtctcactctaatgcccaggctggagtgcagtggtatgatctcacctcactgcaacctccgcctcccgggttcaagcgattctcctgcctcagactcccgagtagctggaattacaggcgcgtgccatcacgctcagctaatttttgtatttttagtagggatggggtttcatcatgttggccaggctggtctcgaactcttgacctcaaatgatctgcccacctcggcctcccaaagtcctgggattacaggcatgagccaccaccaccagcccgactctatttcttaaaaaggtaaaataaacgattaaagttgcactcccaactccccttttcttatcttctcttgtttctccctatcatctttcatcacctgatttgccatatgttttactgaacatcagttccatgctgcagggatttgtgtttttgtctgtttcactgctgtatccccagcacctagggcactgctgggcacaaggtaggttaagtccgcaatatatatttattaacagaacaaataaatgagtatcaaccttcgccaatagtgttaccacaggtgaagggcacaatgaaaatgcttgagtggcttcttctagtgcagaagtgtccttgaacgtataacccatccccgtggacacactgtgctgtgtgtgcccgtcgtgtcctgtacccgctgccccaggacaggagctgcaacccctgagctcacagaccttgctgatcctttatgaaccaatatgcaccctcagaagggcacggttgacaaaatatgtgctgctgttaggtgtctattcattgtcaaatactcaaaagtagctatgaattctaaaagaaaatctgcttagagaggaactagcaagacatctttgctcaggagtgaggcctataaggaaaaatcgaatatcccgctctaaaaactagaaacaagccttgcgtgaaaatgctttgtgatgtgctgtttcatatcacagaatggaacctgtgttttgattccaaggttcgcaacactctacaaagcttaaattttctctgctgctttctttgtagaaaaaacaaaggctgcttttccaagcctttgtgatcatggccctctattactgtgaggcgtgcacacgtatgttactggatatttatgttatgtagtggtctgaagtcagagagcttcagtctggccacttagtgggtgactacggagctgagcatcagttttgctaacctaataaatgagaataaccatggcacttaccttatcagaataacagctcctcttgtgtgagctgttgaccaggagggcacactcaggagctgctggggctctgggcatgctctagatcttgacctgggcaatggttatgcagggcgtgcataggagagaagtcatcaagctgagcctgtaagttctgtgttctttactgtatgtaaattatacctcagtaacaaggaaaaattaattcttacttctggaggttgtgaagatggaatagaaagaacgtaaactatgccttacggaaaaagttttaaaatgactatacagtgtgaatgtgtccatgtatgaatgtatgagcttctgtgtggttggtgtgagattatgtgaccctgtgggtgtgatgtgtctgcgtatgaactaaggtaacggtaatgagtgtgcacctgggtgtcagtatgtggatgcacatgtattgcatgtgcctatgtccccatgtgaggagtgcacagaactgcacaggtatgctggattacatgcttgtgaatggctgtgtgcatgtgcaggtatgtggaggcttctgtgctctgaaaccacacgttctacacaagacagagcctgaatctcaagccagtggttctgggacccagctgtgctcctcacatgaagtaaagtaggggctggctagcagcagggtgtgctccccgcctccccctcacccagaaggaagcaggagactgaaggcctggataaaggttcccagctccctctcccttcccacagctgcaacttctcaaagatgcaaattaccctctgctccatggaaaccagtcctgagagccaaggttgcttcccctcaggcccaaccactaccactatgattggaccccactggaccctagctgcccagcctagggatgggagccagctggagtcagttcctgtttcccaaccagtcactgatgtttttccccctggggtgccttggctctccctgctggctcaggtgttgtggagaaagcctgggctaggagtggtccacatagactgtgggactctggggaaggtaatgctgtctcatctttggggatgctctgaatagcgactgtactatcccaaaacactggagcaaggcctggctctcccagaccctcctgcctggcatatttgctgtggggctcactcacaggacccttagcctacctggattccctattggtgctcacttttcccatctcctaggtcctgtctccccatcagggacatgtgtcttcatcagccctggatgacgtacatcacggggcccagcagcggttcagcacacatagagattccctcccaacccaccctgacaactcccccaaacccaccacctctctgcaggcacccccgaccccaagccttcatctccatggccatgggcccatggttagagtgtgctcaactatcaggaagctgaaatgtgtgggagagaggtgggagaaagcaggaggaaaagtgaagaaggctgggcatattggcacactgtctgtaatcccagtgctttgggaggccgaggcgggaggatcacctcaagcaaggaattcaatactagcctggtcaacatagtgagatcccgtctccataaaaaatttttaaaaattagctgggcgtagtggagtgtgcctgtggtcccagttactttggagactgatgtgggaggattgcttgagtcaggcgaggctgcagtgagccgtttgagctgtttcatgccactgtactccagcctggggtgacagagaaagaccctgtctcaaaaacaaaaacaaaaacggaaggaaacagcacgaaatcaagagctggaggtgtttggaaggtctgggtgctattcgacaccagcaaatatcatgttggtggtgcccacctgtggccctggcctccattcctggccctggtacttacacaggtccttgtggacacctggatgcagatgtgttggctcctgtactccactctcagaagtggtaaaccacagtggtccaagcagttctcaggcataggtttttgggctttttttttttttttgagaaggagtctcgctctgtcgcccaggctagagtgcagtggcgcaatcttggctcactgcaacctctgcctcccgggttcacgccattctcctgcctcagcctcccgagtaggtgggactacaggcccccgccaccatgcccagctaattttttgttttttagtagagacggggtttcaccgtgttagccaggatggtctcgatctcctgacctcgtgatctgcctgcctcggcctcccaaagtgctgggattacaggtgtgagccaccacacccggttgggctatcatttttatccacaggtgcatctgtgacccccacccctctccaggagcccctgacactatctggggtctgagctgagccatttgagctggggtgggcagtgtccacctccagaaatcaggacagtactgcagaaggcaggcccccagtctcttcttcattcagcaagcgtgtattgacagcccactgcatgccgttgctgagtgcagcctcctctccttaagagtaaatcagatctcctcaaccctcttccaggatgctcctttcccgcatccctgtatgccaactcccaccccaaaccaagaaatattcataaagcaagggtctgcctcagataagagctgtggtccggagagagacccctgaacaggctacaaatttttttgattctgcctcccaaacgcccaatgtcccagtcccctctctttgggggcccaggccttgacatctctggcaggtcataatataacaatggtcaccccatactggatacttaccgtgtaccaggtatatgatgataaacatttatatgatggttttaattcttatgacacttctggggtagaaactatcctcattttacagattaggacattgaggttctgaagcctacataaactgaccacagtcacatggctagtaagcagcacagcctagattcaaaatgcagctcacccacctgggtggagggcagaggcaacacttgtccttgaggagtgggaatttgggaaacccttgcaggggaggccaggccagggcagtgttcatccttttcaggtgaggtctgggcctcatggtgacctctgctggcataaacacacccccacaccagctgaggcggccatgttcctagcaccccaaggaccactcatgctcccacaacgtggctcggggcagccatagcctgagacaaggatttcctcacagctcggctgaaattcctccttggcccttgctgtgtcccactgccccatgactgaggtgggaatagggtgcagagggggatgccttggctgctcagaggcactgaaccgtggcaccccagcccatcagggatccagggtgtctcgattgttgaccagggctggggcttggtgcaggtgaacatggcccctgcagggcttctttccttaggccccaaggcagacacagtccccctgttttctcaggcttctccctcacagcccagcaggaggaatttctaggatttggctccagagccccagactggatcttgggaggaaggaccacaggaattaaactaggccctactagggctctggctccactcctccatgcacttgcagcctggttcctgggtggtgtcacccctggcctggacaccatccattccctcatctactccataaccgtctgctgtgaccagcagggagtgtgtgggggcaaaagagtctaaggaaaaggacagaagagaggtcaactacagccaacacagctctgagtctgaggaggggtcttcttggtcagagatccttgcagaaggagttggggcaaaaagtaggctttgagggagcaacagataaggtccaacgtttcactcctttgataacctcaaccagtgctgaggctttaaattccatctccgaggactcccccaccccgccccctgagctgcagccttgtatatccacgctgccagcccagcccagccccttccttggatgcctgctgagcatctcacactgaacaagtccaaaaagaattcctgatttctcccctcaagtctgctccccatgtggtcctgcctcttagctaacagtaacttgtcaatctagtaagtagatcttagttgcttgggcccaaatctcaggggttgtttctctctctctgctcatcctctacatctaacccatcagcaaatactgttggctccactttcagaatgtaatgaggatccaaccacttctcacatccttcgctgtcactccccaggaaccaccttactagtttatctgcatctaccctttcccctacagtttatcctcaacatggcagctaggggaattccagatgtgctcctccctctgctcacaaacctgcaatggctcccatctcacccagggtgaaagccaaggccacttcagtcacctcaaagccccatacaagctgatctcttcagcgctctgacctcatctcctgccccacccaggacctctgcacccgctgcgctctgcctggaggttcgttcccactcaaggtattcacaaggcttagtctcggcgtgttagttaaggcttccccgactgtcccgtatcaaatagttatcctctcttcctcatcagaactcctatcctttttctccatagtacctgtcacgtcctgacacactatatttgtgttccttgtctgtctactacaactagaacacagctccatgacggcaggggtttttcttttttggttactgctatatcccaagcacctggaatagtgcctagcacataaatgatgttcaataagtgaatgaattaactaagtgccaagaggcaaggatggcagagctctcccaggccgggctggggcagtaactgggaagcccctattccctgaggcactgatctcctttcagcctctccagtacactgccctctcccatcttcctgcaggctgtttcctccagccctgtcccatcctcccattcttcaggtctcagcttcagtgtcatttcctcagagaagtctcccagacagccttggactaagttaaggtctcctactccatgctccccaaagcagctttactgccacttgtaaggagtccagacacttagaggtgttagttgctcacaaactgagcaccaggcttatctgctcttgattgcctcatctggacggctgtggattaaatgaggtgattcatataaataaattgttgaataggaattggccaataatggtcaggcaatattgccacaattacagtggatactcagacatttgttgtttgtgacagaagggcagcacaccagaaatcatggttaagccaaaaaatcacagcctgaatcaaccctgggaaatgctggggaaccactgcccacattttaaacaatactgttcccggtgactttggctccttcaagtcctagtgggcctggccaacacacccctggctaacgtcccacagcctgggtggattctgcggggtggggtgggggttggacctcccatgtgtttggaggaccagcagcatccatgggagcttgctagaaatgcagcatcttgctcccttccctaagacctgttaaatcagaatccacattttcacacattcaagattggaaagcatttccccagatcacagtgtctcagaactaagggctaaaaaggatatatatatgtatgtattttttaagtttcaggttctggtttctatactaatacatcttcagtcagtcatgctcactggccagaatccattctctgaacacccttgaccaccaaactcacatatattctttcctatctctaagcagtcttgcctgttccttccccatttccaaaatctggggctgccatgagtgccctcagtgcctgttctcttggcaatcagacagggctgggcaccaggtgatgtcggggaaatggttgggtcacagcaagcaggtggccttctcaggaacctgcgtgagaagggcctgagggagaggccttctcaggaacagggtgggaagcacccagacacaacctgagctgaggcacagaggagacttgagagtgcctgtttgctctgccagaagggttgggcccagaccactgcaattgcttccctgccatctcccaaactcagctgagagccccctccctgtcacccagcccccgtgggaatggctcaggccaggagctaccatcaaactagctcctttctcccagggcctggtgactccttgacaggttacagccccaaagacaaacagattctgccaagcaaataactgttcagcagtgggggtgttggggaaggcctaggagtgggtctgaagctgccagaagaagacccaggtgaagtggggggtgggctcccctgcagagaacaaacagctgtgggcacctggaaagaagcacgatgcaggtacactgtcacgggtgagggcactcaccccaggggtctgtgggccagtctcccaggctctttcactctgggctctgtatcaggctgctccctgagaaagaagagtcttgcatgcaggcccttgggggcagggaaccaaacaatgcttgctggctgatcagctaacttggctgattttctttgtgctggagatacaggtcatttggaggcagtttccttaccttcctggtcactgggcaccagaaagggcaggagaccccattataaacccaggactaatttcccaaacatataatgaacctcagggtctcagttttcccatctgcaaaagggaaaggcccagagaccaaacagtacacatcacagagccattatggggccacacaagtttacaggaggcttgagggtgcaataaaactcaccaacacacatgaaaacagctttttttggtgtgtgtgttaatttaatcatacaaatattcatttatacaataaggaaaaacctcctcatctttatctcctcctaggcaccatgaggccccaccacaaacatccagctggctttctacacacaccactgtccaggtgggaagggcagccactgctgctcctgcattcacccaaggaaacaaaggaaaggtgcggcgaggcagggtggggtgagtaatcagcttgcacttctgagccctggcaaccctaccatcctctcctgctgggctcagattgaatttggggaggtatttattctcatgcccatttcccaccatggccaccctcaggccacaccagctgtttggtgaggttctctccaggctggaagtaactttgatgggcttaaggttacagccagtccttatgggggagagaaggctgactgcttcttgtagaaaaatgccccaaattcaactgtcctcacggcaaaaagaaaaaaagcatgcacacgtgcacatccatccacacacacacacctcactccatgcacactgacagattcttcccaagtctgaacccctctgtctccccaactgggttcagaccctatcacctaaccatggtgtctgcctcacctcctgggtgccagacgcaggtggtcctgcccagaggtggcctgccacttggtgaagattctaagaggagcagggactattggggctgagaggtagccactaccaccccactaggcaggggagcagagaggggccctaggcattgctctgaacccataccagtgaggggagagagaatgaatgatactgataccctccctgggctggggaagccatggacccctctgcctgcactccatgacttgcacttactctggccctctgcaaggagctcatctcgcctccaaggatgtgcacagaaatggtttgttcttgggaagggagacaaggtgcttgggacatttaacttgccaagtgtggttgcctagaagcaagaggaagagcaagacgactctggcaggcccagacccactgacggtggcccatgaagcccctgctgggaaactgggaaggggcacccagtgttgggcagaagaggaagtcaggaaagcaggggttgtgaagcctcccacaatcctgccagggacagtggagatgtgctgcttcaaggctactaagcagtaagaacagctgggcatgcatgggctccagggaggcagtgtctcaggagactggtaccagcagcagcagtctgggcctaatgaggccctcagacaaaaagccatcctgaggcctgtggcgtgggtacctggcagagacttccctctgctctgctagggagtggagcactcccatgtgcacagaaaataggtgctccagagtaagctctagtgaagtcccagacccagctgcaccacgcttctcagcaggctggctccagccacccccagggcttctccagtggaataaagtttatgcccccttttattttttggggggtggggaggtgaagagggaatttcacacaagcttttctcccacaatcaagctctaaaaaaacaacagtctcagaagaggatgaggaggaacaaacaacacacattttttggaactcagacacccagacagaaacaggcaggcagaccctcacccacacccaggctatatgactccttgcagccactcattacctggtctccctgcctgtctcacaccctcacccaccacccagctggatgggggtgtggtaacaggcaggtgaccctgcaacagcaccctggatccatatccctggctctcaaaccaactaagacttgagggaaggaggggggtaagagggactttgcatattcttgtatctttggcagacagctgttctagcctggttcaagcttcccatggagatatccacatctcaacctgctcagaatctacaggatgccagggcaggccacctgcctgagtgagcagccagtcaatcagcctcttgcttcagctgggctgccacttgcccacctcccagccaataatctagcatcctggcagggaggcggggctgtggaggtcctctcatttccatctaaatgtggtctccaagatcaagtagtcagtggctggcccttccccatgacaaattccccctttggggctgtattttcatacctctacagatcagccgccactaacaggctgtgaaaatatcagaggacaactgaagagaaacagggaaaggtgttgtgtgacaacagagaagcatgggccaccttcaagcttgcctactgcacacctgctggtgagttgcaccaacacccgtgtgtgcacatgtggtgcatacatataaccagcacagaggcactgttcccagagcaaatgggaagccactgcatgaagaatccaaaagagcagtaagcatgatggcatttctctctgccaagagaaacatggaagaaaagcaattttaattgttacaagggtgtgcagaaggacacctctcaggcttagaaaatcccacgtcacccgagatctatcctcaaggcttcctctgctggccacacagggaagtttggtcttcagagaggttctgatgctaacaagccacagggttgacgaatacaaatgtcaaaggtgtaaatcaacagaagattaaagagaaaagaggaggaaaagggtgataactcattggctgatgccattaaaaacaaatggggtcagagacttctggagtcatgtggcagggcagatgtactcctgtagcactgatccgcagagtcctcaaacatgccacgccaacttttcacctgaatctcttccagaacaagcactattctataaagaatatgttatcccttatttaaaaaaataaaagtggggaaagagggaaaaaaattaacatgtgctcaaaactacaacctttctgtaggcaaaataatttttgtttaaaaagatggctttttttcccccattttaaactttttcccccttcccgagtgacctaatgacttgttagactgatgcctataacaaaacccaaagtggctgcatggatttcttcttggtagcctcaacaccattcctgtgattcagcattcacacatgcatactgagtttactcaaaactagtctgttctgcttcttcctcttcttccgggatgagagggggtcagagccaggggtctgtgcgatgtggtctgcaatccagaggaaccccttgccctaaccccccaaagtcaggccttctgtcttttgttaatttttcttcttgctgacacccgtttaagactggccgaaggggtaaggcccatggagcccctggaagagagtgaagatagtcagtgatggtacacatagcagtgcaacttgacaaccaaaccaagtgcaagatctatggttcccagtgagtcacaaggaagccccaatccacagacaaggcctgagggtctttgccatacaaaacctcggcaggccaaagatcagtacatttcaagttgctaagtttctcactgaatccaaagatttctcacatcatccaaagagaggggagggtagagataactcccccatctttcagatggtagatcagtcaatgccaaccttcctccacccaggtcacaaagctttcctatttccttcttgacaaaaatgtctcaaccactctgctaaagatccttatatgccattctatgcaccttaacttcagatgtaaggctactgctagctaacaacacatatatcagcaaaaacacagaaatagcaactatttacttagcacctaggtcccaggcacagtactaggggcttatcctacattgcctttaattctcacctcttccctaaaagccaggtgagtattataacacctatttcactgacacccattttactgcagagaataagacttgttcaaggtcacctggttaggccaagtgtggtggctcacgcctgtaatcccaggaccccataaggccaaggaaggaggatcacttgaccccaggagctcgagactagcctggacaacatagtcagaacccacccctataaaaatttttttaaaaaattagccaggcatggtggcacacgtctatgatcccagctacttgggaggctgaagtgggacgatcacttgaacctggaaggtcgaagctgcaataagtcctgattacgccactgcaccactccaggctgggcaacagagcgaaatcctgtctcaatttttttttttttttttggagatggagtttccctctgtcgcccaggctgcagtgcagtggcacaatctcagttcactgcgagctccgcctaccaggttcacgccattctcctgcctcagcctcccaagtagctggcactacaggcgcccgccaacacgcctggctaattttagtagagacggggtttcatcatgttagccaggatggtctcgatctcctgacctcgtgatccgcctgtctcggcttcccaaagtgctgggattacaggtgtgagccaccgcgcctggccaatcctgtctcaagctttttaaaaaaatcacgtggtaagaggcagagccaagattcaaatccaaatttgatggactgcagtattccttcttcccacgctagctctcccttgccacatgataaggtttattccaacttgccaaaggcactttctatgctgcttggctgagtggaagaagcttcacagtcttgcttccccttataagaaagacacaccaagatgtgccaacatcaaaagcagctacacaaaccacgaacacgctggaccatgacgtgtgcttcctccccaatccctgctttttgtttttccatataaagcctcccaaaaccagaaggacatctctagctgcttggtcgtatcactaaactaaacaaaaaatcctcaggagatgatttggggaatggacaggccaataccaatggggcatccactacgtgccaggtgctgcagtagcacc

SEQ ID NO: 358 - DNA, 108146 bp, Homo sapiens
aagaacttgttcttccaagtttccttgttcctggctactataggcctgaagcctgaagccttttattataacactaaaactggacagtctcctgagacaagacctcctactgtactctttctggggaagcagaactgcagtgacccacttcaaagatattcagaggctgagcggtgcagggagtgctcagttgctggggatgggatccaagtccatttcttagttccacacagcagcaaatcgcttcaccttcttgaagcctctcctctgtaaagcgagagggctaaatgggtccatctctaggggccttccctcccaggtctgtgtctgatagcatacacacacacatatatatacacacacacacacacacacacacacacacacacacatacatacacacacacatatatatacacacacacacacacacacacacacacactctctctctctctcaaacacacacaaatgcccaaccagctctaagagggcactgaagaggtggctggacatgtgctgggtcatttttagggtgaggtgtagggggtcttttgcttctcccttctcatattttgttttcttattgctgctcagaggggggtaaggaatggaggggccatcagaacttgaatcctttaacatccaccaggaagttttatgaagagtgggtgataggatctaaaatctctgcagacttttttcctcccgggagccaaatatcacatttccttatggtgcccacactgactcaaccagaactggctaccagcttcagaaatgtgttacttatgttcaagtaatttgttataggaatagatgacatttttttttttcaaaaactttggatttggcatatagtcatctatagggggattggttccaggatcccctgcagatgccaaaatacatggatgcccaagtcctcagctaaaaatagcgtagtatttgcatataacctatgcacatcctcctgtatactttaaatcatctctagattacttataatacctaatacaatgtaaatgctatgtaaatactcgtactgtgtggcttttaatttgtatttgttgttgtattgttatttatttttgagacagagtctcgctttcttgccgaggctggagtgcaaaggtgccatctcagctcactgcaacctctgcctcccaagttcaagagattctcctgtctcagcctcctgaatagctgggattacaggcatgtgccaccatgcctggctaatttatttatttgtttatttatttatttttgagacggagtctcatcctgttgcccaggctggagtgcagtggcatgatctcagctcactgcaacctccgcctcccgggttcaagcaattctcctgcctcagcctcccgagtagctgggattacaggtgcccgccaccacgcctggctaatttttgtatttttagtagatatggggtttcaccatgttggccaggctggtctggaactgatctgcttgtgtcggcttcccaaagtgctgggattacaggtgtgagccaccgtgcccggcctgtattgttattctttactggcttttcttcctgaatattttacatctgtggttgattgaatctgcttagtggaacccacagatacggaggaccagctactaaatggtgaaccttcagttggcctccaaaggggaattcaatttaggtaatagttcattgtagcaaaagccaagaccaaaatcgattctttaggctgtcccctccctggggggtggtgcataaaaacaggattttgttgattgtctgcagtgaacaattctgaggaaaaggtgttttttctggtccttgtccagttagttagtaaagaaactacctgggtgtgctgttctctcataggggaagtgtgggtaaagagctgaacagatgaatcttgttgcttgatcaaccgatcagtgatacaggaacagttttcctatctttggctgtcagctgtgtgtttggccaatgcactgtgacaacctgctcagtcactaggaatgagtatcccagtgttgtcacagttaaattggtggtgggaacttccataatgggatttgatcttgtcacttggtccatggcagctagtttatgagaatgatcacatttgtgtgtatatatatatatttatatttatatatattttttgagacgaaatcttgctcttgttgcccaggctggagtgcaatggcgcgatcttggctcgctgcaacctctgcctcccaggtttaaacgattctcctgtctcagcctcccgagtagctgggattataggcgtgtgccaccacatccggctaattttgtatttttttttttttttttttttttgagacagagtgtcgctctgtcacctaggctggagtgcagtggtgcgatcttggctcaccgcaagctccgcctcccgggttcatgccattctcctgcctcagcctcccaagtagctgggactacaggcgcccgccaccacacctggctaattttttgtatttttagtagagatggggtttcactgtgttagccaggatggtcttgatctcctgacctcgtgatccgcccacctcagcctcccaaagttctgggattacaggcgtgagccaacacgcccaggctgtatatatgttttgagtgcagtggcgtgaaaacggctcactgaagcctcggcttcctcagctcaagcaatcctcctgcctttagcttcccaagtagccaggaccacaggtgtgtaccaccacatccgcctaatctttaatttttgtagacacagggtatcatcatgttgcccagcctggacattcatattttcttttgttgataaaattaattcacagtcggccaggcacggtggctcacgcctgtaatcccagcactttgggaagccaaggtgggcagatcacctgaggttgggagtttgtgaccagcctgaccaacatggtgaaaccccgtttctactaaaaataaaaaattagccgggcgtggtggcacatgcctgtattcccagctactcgggaggctgaggcaggggaatggcttgaacctgggaggcggaagttgcagtgagccgagatcgtgccattgctctccagcctgggcagcaagagtgaaactccgtgtcaaaaaaaaaaattaattaattaattaattaattaattcagtcagtatctactttatgcaagcttgatgaatgacaaaatttgacaaattctgtagcttagtgacttttctatcatttatctcataatttactttttgaagaggtacaaaaaaaatttccagaagtctatccttggccaggcgtagtggctcacgcctgtaatcccagcactttgggaggctgaggtgggaggatcacttgaggccaggagttcaagactagcatgggcaacatggcaaaaacccatctctataaaaattacaaaaattagctgggtatggtggcgcatgcctgtaatcccggctacttgggaggctgaggtgggaggatcacttgagcctgggaggttgaagctgcagtgagccatgattgcaccactgcactccagcctgggcaacaaagcaagactctgtctcaaaaaaaaaaaagtctattctcaaaatatttcactgaaatggcaactttagtggtctgcagaagctgctaggggcttaaggtgcatctgcctataacccacaccttgctcagctactcgggaggcagaggcaggacaattgcttgaatctgggaggcagaggttgcagtgagccgagattgtgccactgcactccagcctgggtgacagagcgagactccgtctcaaaaataaataaataaataaataaataaataaaacaaaaaaacaaacaaaaatcagtaatgtcagcactccttttatgaagtcaaccttattcttttctcactctggcttgcctctctctgctttgggctgttctgtagagtcagttatggtgctcgagcttcactgacagccctgagtagatatggtcaaaataggaagggccagtcatttataggtgaaatgtgaacctgaagaatatcctcagtgctcatgacctgacaatcctgttacctactgctgcttaacaaattactccagaatgcagtggcttaaaacaacatacatatctcagtttctgtggattaggaatcctgacaaggtttagctaagtgtttttgcctcaaggtttctcacaagctgcaattgtgttggatccacttccaagctcagtggtggtttgcaggattgtttttcacagtttgttgggatggagggtctcagttcttttttttttttttttctttttttttaattattattatactttaagttttagggtacatgtgcacattgtgcaggttagttacatatgtatacatgtgccatgctggtgtgctgcacccactaacgtgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcagaaatgtcttcttttgagaggtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttacgattgacttggcgatgcgggctcttttttggttccatatgaactttaaagtagttttttccaattctgtgaagaaagtcattggtagcttgatggggatggcattgaatctgtaaattaccttgggcagtgggtctcagttctttgctggctgttagcctctccttagggttactcatatggcagcttgtttcccaaaataagggtttgaaaggagagcaaggcagtgtgcatgggcagagaagccagaccatttgtaactgtctcagaagtgatatcccattgcttctgccctattctaacagaagaaagttcagcccacactgaaggcaaatggattatatgaataccaacaggtgggaatcacaggagcctttttaaaggttttcacaattacttaaattttctgtggaaatgggcatttatcagaatttttttttttttttttttttgacagggttttgcttgctctgttgcccaggctggagtacagtggtgtgattacagctcactgcagcctcgacttcccaggctcaggcaatcctcctgccgcagcctcccaagtagctgggactacaggcatgcgccaccacacctggctaatttttgtcttttttgtagataggggttttgccatgttgcccaggctggtcttgaactcccgagctcaagcaatccatccgcctcagcctcccataatgccaggaatgcaggcctgagccaccacacctggctatcagaatgctttatcaggacagagattagattctggtatccttatatgttgatggatacatgtttgttttgttgtaaattaagttgatgaagatgaatggttaaggattccaaccctgaaaacccatctcacttttgtcatctgtcttcaaaggatttataataaggtctactaaatttattttccaatatcaaccactctctcctctatcctagtgaatccaaagcaaccaatgcaaacaatcacatcttagtggcacaactattaagaacatagctcaaatggcaggcagctgatgcacttcaataaacagtctaattctgccatttggagggcaacgcttgttattgtattaaaataggcaaaaagtagatctaaattaaggacaacaggcagagattattattttaaaaagtgaacttggaaggatataaaatcaaattgaacatcatatgtattagaaactctcctccctttagaagaaatggtgcagcctgtaaacacaactacgtaccgaagtaaacttgcttaatcctctggttgaattttttttttttttttttttgagtcagagtcttgctctgttgcccaggctggagtgcagtggtgcgatctccactcactgaaacctccgtctcccaggttcaagcagttcccctgcctcagcctctcaagtaactgggattacaggtgtgcagcaccatgcctggctaatttttaaatatttggtacagatggggtttcactgtgttggccaggctggtcttgaactcgtgacctcaaatgatccaccggccttggcctcccaaagtgctgggattacaggtgtgagacaacatgcccggccccaaatttctaaacacttaacattatctcaagtgtcctggcctttaaactgggatatttctcttgtatcataaggacttagtgtggattaatatttttgcgaggacttaaagataaatgcatattacacatgtagtttttatttttttgagacgaagttttgcttttgttgcccaggctggagtgcaatggcgccatcttgggtgaccacaacctccgcctcctgggttcaagtgattctcctgcctcagcctcctgagtagctgggattacaggcatgtgccaccatgcccagctcatttttgtgtgtgttttttttttttttttttttttttttttagtagagatggggtttctccatgttggtcaggctggtctcgaactgccgacctcaggtgatttgcctgccttggcctcccaaagtgttgggattacaggcgtgagccaccacacacggcctacacatgtagtttttaaactccaacttttactttactgcaatctaccttcccaaacctccaacttaaatgtctttagcaacacacaaaaaaacttccttcccagttggcctcaggtttatagtcacttttctatattaatattctgaagattttgtaagagctttatgctaccaatgctttgctatctcccaaactgcactgactattcaagcttctctggtgccttaaggtcttattaaaaaaaattttttttgtagtgatggagtctcatgctgttgcccaggctagaatgcagtggcgtgatcatagcacactgcagccttgaaatcctgggctcaagcaatcctcctgcctcagcctgagtagttgggactacaggtgccagccaacacatccggctaattttaaaattttttatagacacagggtcccactatgttgcccaggctgatcttgaatccctaggctcaagtgctcctcctgccttggcctcccaaagtgtggggatgacaggtgtgagccactgcacccggccataaggccttattttaaagcaaatgtaagttcgattatcagcaaatcaccaattttctgtgatataataatctaagggcaaagcagtttccttataaggctaaactggtaagagtacaggtttcaaaagaaaagaatgggcagtaacgaagtccacttataagctgggactgctctgcagcagctaaatagtttccctgtggacacgcagagcaaattcagaattaaagggggttgtaaacccacctgtttgttggctcttttgagatagctacaagctctcctgtaacagcactaaggtttcccccaattctgggaattctaggtccatatatttaacacaaggtgtaggagggcctgcctaggttggtcagtctggtgaacaaactggtttcatggattccaataggttacattttaacactatgaaaacactgtgttctaagtattgcacaattaaaacaaattaactagaacaatttatgtagttcaggtgtaggtggggaaagatgaataacactaaaaactaccacaaataaaaatgaaaagtaaattaaaaactagacaagtgtatgaagcaaaaaataaattatctctagtatataacgagtcctgaccaagtcatcaaatacggaagcactccaacagaaagctggacaatttacataaataatcaaaaaatgcaaatacctatgaaaagtttatgacctcaccagtaatccaatatgcaaattataacgatattcctgtggggagggggcagggcacaaactagcgattcataataggcctgttcatacattggtgtatacagaaaaacagtccaaccattctgctagttgtccagataagttaggcaatatttatttatttatttatttatttatttatttattgagacggagtcttgctgttgcccagacaggagtgcagtggcgtgatcttggctcactgcaacctccaaggttcaagtgattctcctgcctcagtctcccaagtagctgggactacaggtgcacgccgccatgcctggctaatttttgtatttttagtagagacagtgtttcaccatattggccaggatggtctcaatctcttgacctcgtgatccacctgccttggcctcccaaaatgctgggattacaggcatgagccaccgcgcccggtggcaatatttattaaaagcctcaaaaatgtgctctctggcccagacagttcaagaatctatccaagaaatgagataagtgtatgaaagcctgtgtaatacatcatgccattgccttaataagagcttatatttctaagtcttctgaattttgcacgtaccgtgcatttataatttgagaaaaacaaccacccctgacaaatcttctggaagaaagtgctattggatgtagggaaaaacaattaaaaaaaaaatgctgaaaaacagtattccaaaaatgttaatttggctgttaattctaccccactcccaatttaaaactagaagcaaaactatgaaccccacaaaatggcaagtgtgcaatttgtacactttcattgcatatttaaattaaaaaagcatactcaaccaatcttttcctccttttactcagggcagagcaatttggacaacaaatgaacagagatttttggaaacatgtaggttattaaataatttgtttattgtacggcatttacaaagaaaacagacaatgccctcagtagaaagaataaaaatgtatttagggctttatttttaactgacagcaaatagaaatcctttagtgagatcgtggcaatttgacagtattataattaagctcaataaaggtacatggggtacctggaagatcaagatctacagctgcctatttccacatctttcaatccatctggctccttaaataggggaaaaagcccttatttggtggagaagcatttccaaaatgaagttacaggttctattaaaacttactgtcacatcaactgttaaaatagggccttttgtgttttgttatttcaccttaatatcaccagaattcctgtaattccacaattgtgattttactatgtagaagataattcagttctagtctattgctttagatgtaaaaacagctgaaaacccaaagtggattagaattgctgaaggatttccctgccgttgtttgatacaatctattctcttgattcttgataggtgcatagaaagcctaacttaaaattctttctacaggaacatgtctgatttcaggagtacccaatgaaggatccgatgaatggctggccagttactcagagtaatatgtttatgagttaaatggattgcataacggcaccacttttcctttgtcactgtggtggataaatgacaaagtagattccaatctcctgtatagaaaggtggttacccaatagcctcactggtggcttgctagcagagcctcaagttgcacctctgtggctttctgtaaattcgagtcctacagccacttcgagaacgctgcaatccccaaggcccacttggtccatgctgaagaagcggctgtgaccccaatcctgcctctcttttgctcttcagtattacttactggaggaatatgtaatattctaggtcaagtctaggagaggctcatcctaaaaaaaaaattgcaaagtcttttctcaattaaaacaaaaaagcctcaagtacatctcaatcatgtcaaaattatggttaaaaattgacattatgtagggaaatagcagcagagaatggctaatcttaaaaaataacgaaccaaccaaccaaaaaacaaaacaaaacaagaccaacaaaaaaaagtgccatcccacccctccccttggttctttcatttggggttatattaaagactcgagcctctgagaaaatcagaaaggcaaagccatagaggaaaactgcttcaaggccagaattttgggtaaggtaaagaaaaagctgtacatgaaagcaggggactgtttggaaaagaatcagaatctcaagatctatttttcttaaatgggaaagctctgaaacccagatctccgttctaccatcatcctgatcctttagttatggggcaataaactcaagtgcaatgagtaaagtgccagccatggatacaaaaacaaaaaataaaacaaaacaaccaaccaaaataactctggtcttagggtaatagaagacatacaggaaaggactgtttatagaacacctgaggttctcaagaaattactattcaatggttctgtttttgcttacattaaaaatcagactgaagattcaaagatcttaactattaaaggatgaaaggaatttgacagtgctttgaacagtgataaaatggtacccaaatttggtgttcatatagctatttaaaaaagacagtagcttaaaagttgcaggaaaaaatgtgaacacagagaacaacagaaacagtccaggaagatgatgcagcccggacacagcaagtttaatgtctctgctgtacatagaattaagaccctttccccctcctcatccttatgctggcaataggatatgcactagaaaatttgactcttagagtcaatgaataaaaggatgggctcatacaccttcatagctcttttcaaaaaggatgcttataatttaaaggatgtcctaatgggaaggaaaggtacagggcaagaggctgtttcacattttagtccattagtctttggcagagcccaaccaaggccaaattcacctaggatgcccaatggctgtggggatctccacagggtcaagtaagcaaacccaaatgaacatgttggattaaaaaaaaaacaagatctagaaactcttgaaggaagagcttcaccctgaaaagggaagaggaaaatgcttgaaggggaagggcggagggtcagtgtgtgatctctgctgtggtgctgggcaggggcttaggagttaagccaagggtgccggagacactcggcggcagtggctctcttctcagggatcagctccaacatgggcagtaagaaatctgtgaagccagctgcctcttcctgcgaccactcatacttctccactagaacctcaaaaaggccccaaggtttcagcttcgtgatatgtttcaggtcacctgcagtgaagacagtacagaaaaagccactgatcaacacagacaaatgacaaggtactcttgtggaaacccacaaactaacccatgtagtctatgaggaatcaaattttgcaatcagaatctaatccttcattcacaaagcatttcttttctgacatatgcctcagaaagaagtgcctctattcttcatacggctccaaaaatttaaggtaatttgttttctcccctattctaggatttttttggtcccagtcaaactgggtgtgacaatcaagaagtaggtatttactactaaaataaacatgaaatgcctatgtcttcaacatggtcttatatggtgtgcagagacactctagtaccacataccgagaataatttgcttatactctttttttgtgtatgtgctcaatagtttagtaaatgttgctttacagtgaggcagtaaagttaaaacatcatgtcaagcatggataaaagcaacaaaaaaaaccccaaatcctacacagttttcagatacaacagcttcatatactctataccaggggtccccaactctataccaataccccctatggtaccagtctgcggtctgtcaggtctgcacagcagcaggtcagtggtgggccagcaagcattactgcctaagctccacctcctgtcagctcagtggctgcattagattctcacaggagcgtgaatcctactgtgaactgcagtagggatctaggttgcatgttccataaaagaacctaatgcctgacaatctgaggtgacacagttttatctccaaaccaccccccaacccccccatccattgaaaaactgtcttccacaaaaccagtccctggtgccaaaaagattggggaccgctgctctacactatactggagtatcaacctaattgcttctttgaagtgacaactttttaaaagatagtcaattattaatagctaaggcaaatgctgctttaaaattttaagttggccaggcacagtggctcatgcctgtaattccagcactttgggaggctgagtcgggtggatcacttgagctcaggagttcaagaccagcctgggcaacatagtgaaaccctgcctctaccaaaaatacaaaaaaattagctgtgtatggtggcacatgcctgtggtcctagctacttgggaggttgaggcaggaggatcatttgaacctgggaggtggaggttgcagtgagccaagatcgtgccactgtactccagcctgggtgacagagtgataccctgtctcaataataataataataataataataataataattttttttaaacataaaaattttaagtctcttttgtgagcagtgagtgcctatttgattacctacctggtaaacacacatgccttaatctgactgcacatgaggaggaactcttatgaaacattttacaattttcccacctaaaaagaggtttaagaaagggtaatgtttctgaggatggctcctgccaaggattgagaaaagtcatttttctcagcacttctgtagaagttgtgaggaaaaagggaaccatggcacaatgggggtagaaaaaccagaccatttcctagatgcttctaggtcaggttttcacatttcaggttttttttgcaatgcttaagaaatatattatcaagtcaaaaattggaagttttgtttttgtggttttttttgtaataacaaatacataaaactaaaaagtgtgaagttcgtttgtatgactaatgtacttcgagtgactgtgttaggtgtcactgggatgcaaagatgagtgagatgtagtccctgcccttatgtaagaagcttaaattacctgccctttggtagaggcagttcttagaccaaacgccagcaaaaaatttgcccatttttcagaagtgctatagaagtaatcaaccaactgcatgcaggcactatacatattaactgttagtaagaagtatactttattattatctccattaagaaatcagcaaactgaggcacagttagatcctgtcaaaggtcacatggctagtggagtagccaggatttgacagtctggctccagtctctgctcttttttttccccgagacaggatcttgctctgttgcccatgctggagtgcagtggcaatcatggctcactgcagccttgacctcccaggctcaagtgatcctcccaccccagctttcggagtagctgcgaccacaggtgtgtaccaccatgcccagttaattaaaaatttttttttgtagagacagggttttcctgtgctgcccaggctggtcttgaactcctagactcaagtgatcctcctgccttggactcccaaagtgttgggattacaggcgtgagccaccatgcctggctccagtctctgctttttttttttttttgtgagacagagtttcactcttgttgcccaggctggagggcaatggtgcgatcttggctcactgcaacctccgcctcccagattcaagtgattctcctgtctcagcctcctgagtagctgggattacaggcgcccgccactcttcccagctaattttttgtatttttagtagagacggggtttcaccgggttggccaggctgttctcaaactcctgatattgtgattcgcccaccttggtctcccaaagtgctgggatcacaggtatgagccaccgcgcccggctcagtctctgctcttgaccactttttttacctcttttttatctctttgctaagtcacaggttagcattcaaggcaggcccatcattctgtaggacattgggaatatgtgcttacctcttcatttttaaacacttctgcctccttaatgtctgggaacacatttactttaccttttttggtgaaaaattccttggaatattttcctgccacaatgagcttgcgaggcaccttccccagaagttctatgatcaatgcaatgtgatctgtatatttcaaacatttcaagaggggggaaaaaaaagatccgtaacaagagtaacaaatgcagctctagaaaacagcagaaggagcagcatgcacatctctttgtaaagcctatcaggcttactttctatcctaaatgggaagaggaagactctatccatctaatggagaattcacaaagtcaaatttttgtggattcagtgataactaaaaacaatcttggtgtgaatgctctgcttcctgaagtatccctgggtcctacataacaatactacctctgtgactgaagaagtcttgtgaatatttcccactgagggaaaagcgtcttggaattctgcctatcagctctataatgtgcacaatgtggtctaaaatagaagggtaagaagaacagatcaaggacaagctgtaaaagaggtttttctatgaatagctttttcaaggactagctgtttaaaagtaactacaaataaaaccaaggatactgaaggaagactgactgggaaggccaagaattatttcaggtggttggtcacccgatagtgtctggcaagtcccattctggattttggaggcttatcttcatctttagttctattttgtctatatatctaggttcaggtaggttctttaggtaagataaaaaactgtccaaatatgtgttaggcattctagaactattatttgtgatcattctgtctcagcctccccagtggctgggatttcaggcatgtgccaccacacctggctgacttaaaacattttttgtagagatgaggtcttggcatactgccaagctggtctcaaactcctgggctcaagcaatcctcctgccttggcctcccgaagtgttgggattacaggcctgagccaccacctggctgataccccattttaaagatgagaaaatagaacttcaaaaagcatgaatggcctaacttgaaacttcagggctaatatgagctaaaactcagatgaaaaccaatgatcttatgtcttgtctaaagcttttaatttcttcctaaaatcactttttaaaagtaaagattagcacaaacattttaaagtatagctgcttgatgatctgtaaacatcacagtatgaatatggaccatgagcacaaccagggaggcatgcagcctcttaaccaggaggtgagtctgggaccaaccagtacacacacctcaggtagatctactgcccccccccttttttttttctctctgcaggtgacagaagttaagaatataaaacttttttttttttttgagatggagtcttgctctgtcgccaggctggagtgcaatggcatgatctcggctcactgcaacctccacttcctgggttccagtgattcttgtgtctcagcctcctgagtagctgggattacaggtgcataccaccaggtccagctaatttttgtatctgtagtagagacagggtttcacatgttggccaggctggtctcgaactcctgacttcaagtgatctgccgccttggcctcccaaaatgctgggattacaggtgtgagccactgtgcctggcctgtattttttgtagagatggggttttgccatgttgcccaggctggtctcaaactcctgggctcaagcgatccacccacctcagcctcctgaagtgctgggattacaggcgtgaaccaccacacccgggcataatactcctggccagaaaaaaagctttagaaaatacttttatcgtgtagttacagaatcattaaggtttaaacttccagttatgtatcttataggggaaataacatgctagagacgtccatattatctgggaatttgtgaaggtttcaggttttatctttctcatgtaaaggagttagtggtgtcatttaaaggggacttcacatttatgacttccctacaacctttgagcagttttgactgaatttatggtttggtaacaagtacctgcatgccaagaattttctgctggtttttggcaggacctgcaaatgtgtttttaccattaacaataacaaaaataagaatactaaggaaaaacttagactataatttctaagagagcttcttaaagttcttagaaacttaagtaaacttccaagtaaaatattggtcctttaaatatttttcctataccaaggaattcccttgaaattgttactttacacttaattcttgcaacctattttggcttatgataggattgatatacttgacagataaaattatcaggtattatcccatgagttagggctgtggaaagccagagtagaggacatggtactcaggcttctgtcctaccacgactcgtaacaaactatgcacacactagtcaggggtaagggtttgcttgttcctgctcttataggtcaaactgcagcagaacagcatcggtggggctgatgtttgacctaaggactattagtactaactggtataggatggaataaattagaatttaaacatctagggaagatggtttttccttgtccccttatttgggactctgcatatgtattaaaattttcaggtttggtagcataaggtaacacccgatataattctagccactatatgtgttctgtaccacacactaccatttatggagaatctagggaagtaaaggggaaaaaaattaattaccctcccaaacaaacatagtaggtagtctctaggcctataatcccaaacactgtaagcctataaccctaaacctataacccagaaaaatagcaagcagagagtaggtaaaatcaagtagtaattatagtatcctctaacatggggcttatatatacaaaatatgtccaaactctacccacttaaataggcattcatgggaattacatagcatagcattttccaaatggtattcattaggaatattagcaggtcctactaacattacctattaatatcccagaagaccacattttgagaaacaaagagcactcttggttccatacagcatgaaatatgcattcccaaagattcaaggaaagcacaaaaagtaaagaacatgctctacattgggagggtagatgctgtagtgatatctcaaaataatcctcattaatcctacaactaaaacataagctgcctcaactgtataaaacattttcttggctgagcgtgatggctcacgcctgtaatcccagcactttgggaggctgaagtgggtggaccacgaggtcaagagacagagaccatcctggccaacatggtgaaaccccgtctctactaaaaatacaaaaattagctgggcatggtggcacaagcccgtagtcccagctactcgagaggccgaggcaggagaatcgcttgaacgagggaagtggaggttgtagtgagccgagatcgcaccaccgcactccagcctggcgacagagtgagactccgtctcaaaaaaaaaaaaaaaaaaaaaaaaaatcacaaaaccattttgtttgttcattcaaattattaactcatttagttatctggatgccatcataatagaaaaatcagacacacacagttgctgcttccacagtctctcagacaaagtaactggcagcctaggcttttcccactggctaccacaacatgtaaatccattctactttgttttaaaatggaattccaaaaaagaaaaaattagttttatattcagaaaagggaaaaaagaatgctaaattttggcagaatttatagaaataggatatagtctctgcattcaagtagtgtgtgtatattaaaataactgacctctaaataaatttggaggcataattgagcaacaggttgatgagcaggtaaaaaactgggtaaagaatgaaccactgatatatacagaaaggaagataactagatgttgaagaaaaaattgtccagcacacagaagttttaggtgaactgtggccttttgactctgacagagctctttagtatctttcagaaaatatctaaaaacctaatataaaatgtcttttatatttctaacttttctgggatttacatgttttgcacactaacaagactaaggctcttcggtactaacaaatgatgttagcttaatgtggaaagtgtaaataccacgcacacacatccatggttaaggggactcaccttcatctcgagtgtactcttcccctgaatgaggttcaaacaaatagtcacctgtggccagttcaaaggcctaaaaaaaaaagaggacagtatatgaaagcacaaaagaaaagaaggcctttggaaagctgattgctatttggctcaatatgaagtaactcttgttcccttgggaaaacttatagatcatttaaaaaaaaaaaaaaacaaaaacttaagattattcctaaagcattccttccacatccctatcttaataaaatggagaaaacagcaaagactcagtaaatactaacatgtgggttatttcatgcccaaacctccccaccctaaaccctagcaattcagccctcctgagtttcccttttttggccggaaaggggcatacctggatattaaggtgattctaagttattattcatgagaagaacaggtcttttttttttttttttgagacggagtctcactctgttgcttaggctggagtgcagtggcacggtctcggctcactgcaagctccgcctcctgggttcacaccattctcctgcctcagcctcccgagtagctgggactacaggtgcccaccaccacgcccagctaattttttgtatttttagtagagatggggtttcactgcgttagccaggatgttctcaatctcctgacctcgtgatctgccaaccttggcctcccaaagtgctgggattacaggtgtgagccaccacgcccagcccaggtctttcttacattataatcacacatggctagaaattgagattctgtaccaaacaaaaaaaatcaaaaaaaaaaaaaaattcagacttctacttatgactctttagtgtttgacaagtacatcattaacttttgcataggaagtactccctagattgtcccagatgggaagttcctgattcctaggtcctttgtttttgagatggaatcttgctctgccggccagactggagtgcactggcatgatctcagctcactgcaacttctgcctcctgggttcaagtgattctcctgcctcagcctccggagtagctgggactacaggtgcatgccaccacgcccagctaatttttgtatttttagtagagatggggttttaccatgttggccaggatggtctcaatctcttgacctcatgatccacccgcctctgcctcccaaagtgctgggattacaggcgtgagccaccatgcctggccaattcgtaggtctttagaaaatcagaagattaagtgtaaagggagtcaggagcctagcctatgtgactggcaagtcagcactccctaattaggaaaagaaaagcctgtctcctttaatagaaaaacctcttacagtgctcgagagtgtcttaggaaatgatatccttgggaataagtgccatgcagaatgaaaagcagggctacataaatcctcactgattacaaatggagttttaaaaattagtacacaacagcagttttttttttttttttttggatggagtctcgctctgtcgcccaggctggagtgcagtggcacaatctcggctcactgcaagctccgcctcccaggttcatgtcattctcctgcctcagcctccccagtaggtgggactacaggtgcccgccaccaagcccggctaattttttgtatttttagtaggacagggtttcaccatgttagccaggatggtctcgatctcctgacctcgtgatccgcctgcctcggcctcccaaagtgctgggatcacaggtgtgagccaccacgcctggccaacagcagttttaaaaaatgaccttattgatagggaagcacagttataaaataagcgctagtcataggtcaattttgattaaatcaatggtactaagcagtccaaacaacctcaagaactgtagagtccaggacttagttggggcatattctcaatttagacccaagtttaggtcctggtggctcaccagtgtcagtttctgcagtttcatgacagaacagcctttctcaaaactgtactaccgtccagagggagaccacaaaaccagaagtttcaggataggtttaggaatcaaatactatctctaaatgtcagcagtgctatggcttcttgcttggcattgcttattttacatttcagttgtttattaagaaactgaaccacagtgatagagcagatacttgttctaccctgagttgttccgaggtttatagtcccaaagcaacagagaaacaaatcatgattcttgttcaccaaaacttgtcaatcattcctgataccagtactttaaaaaaaaatctcatggtctcatatatagagttcagtaaaaatactgaaattaaagttaaaaaaaacaaaaaacaaaaaacacagagccagccgcggcagtgctatacgcctgtggtcccagctattcaggaggctagaaaatgaaatactcttcagtgctaaaaagaaatgagctattaagccgtgaagatatggaggaaccttaaatgcatattactaagtgaaagaacctaatctaaaaaggctacatactgtatgattccaactatttgacattatggagacaataaaaatatcagtggttgccagcgagtgggggacgggagggatgaataggcagagcacagaggagttttagagcagtgaaacgatattgtatataataatgatagatacatttgtcaaaacttctaaaagagtgaaatgaaatgtaaactactgactttggttaataatgatgtgccaatgtaggttcattgtttgtaacaaatgtatcactctggagcagcagatcgacagttggggaggctctgtgtgtggggagcatataaaacttatttgtactttttgttcaatttttctgtgaacctaaaactgctctaaaaaataaagtctattaagaaacaaacccaaataaaaccagtgtaccatcctttgttaaccttctctagactattgcctttgagaagaatggcttagaagatagcatgaaatgcatggaaaagttaaaacaatgacaatttaaacagactaattacattcagatccagaagtaaattgcaaactccaggtagcagaaaggaatactgacacagcttgaggggcaatctagcatttcataagcaatatggttgtgtgtggtcagaatgccaaggagtgattaccaaacagaaaatgaggagtttcaggtaagagctgtttctataaagtaacatgtccatcatctgtatcaatgggctggccaatggctgtctcaaagtgaggaagacaagtcagagtcctgatgcttggccttctgcagagatgcaggtgtgctcaatgtattaacttaagggcccttatcttgaccccaggtttgaccacattaagaaaggctgaagtgctggaaatgttattttagaaaaaaggaattaacagatgattcaaatttcctgtcttcaacaatccataccaaagggaagtaaaattccagagcagggctggaggctggaacaataaagtctgttttaaatttaaaaggttgccaaagaataggggaaaagggaaacacggagtttttcttcaatggtatatagagtttcagtttagaaagataaaaaatttctaaagaggccaggtagggtggcttacacctgtagtcccagcactttgggaggccaagacgggaggattgcttgagcccaggagttcaagaccagcctgggaaatacagtgagatcccatctcttaagaaaaaaaaaaaatctaaagatatgttgtataaaaatttgaatataggccaggcgcagtggctcatgcctgtaatcccagcactttgggaggctgaggcaggtggatcactcatgctcaggagttcgagaccagcctgggcaacatggtgaatcccgtctctaccaaaaatacaaaaaaattagctaggcatggtggcacatgcctgtggtcccagctactcaggagggtgagccgagattgtactactgcactccaacctgcgtcctgcatgacagagtgagactgtgtctccaaaaaaaaaaaaaagactaaaaaaatcagaaatgaagaaatgaaagaggagacattataatgaataccacagaactacaaaggataagagactactatgcacaatcatatggcaacagattggataacccagaaaaaaatggaaaaattccttgacaatataacctacaaagattgaaccatgaagaaatagaaacaagagattagatctgtaataagaagtctcccatcaaagaaaagcccaggacctgatggcttcactgctgaattctaccaaacatataacgaagaagtaacagcaatctgtctcaaactgcccctgctactgccaaaaaaagacaaaaaccatatgatcatcttattagatggagaaaatgcatgtgacaaaattcagcatcctttcatgataaaaatgctcacacaattaggtatagaaggaatgtacctcaacacaataaaggccatatttaagaaggccacagctaacattgtactcaatggtgaaaaattgaaagcttttcctctaaaatccagaacaagactctccccacttctattcaacatagtattgtagtattggcagtccttactagagcaattaaaaggcagccaaacagaaaagaaagaagtacaaatgtcagttagctgataacataacttttttttggcaagatggagtcttgctctgtcatccaggatggagtgcagtggcacaatcatggcttgcggtagcctcaactccggggctcaagtgatcctccttcctcagcctcccaagtagctgaaactacaggtatgtgccaccacatctggctaattttttcatttcttttggtagaaatggggtctcgctatgttatccaggctggtctcaactcctgagctccagtgatcctcctgcctcagctttccaaagtgctgggattacaggcataagccaccaagcctggcctgacatgatcctatatatagaaaaccctaaagactccagcaaaaacccgttaggactaataaacaaatacagtaaagttgcaggatacaaaatcaacacacaaaaatcagcagcatttctgtaaactaacaactatctgaaaaataaaccaagagaacaatcccatttacaatagctacaaaaaaaaaatacttagaaacatatttaaccatggaggtaaaagacctgtacactgaaaactataaaatgctgataaaagaaattgaagacacaaataaatgaaaatatatcttatgttcatggtttggaagatttatttttattttatttttttttttgagagagggtcttgctctgtgatccaggctggactgtagtggtgtaatctcggcttactgtaacctctgcctcccagcctcaggtgattctcccacctcagcctcccaagtagcatgcaccaccacacttggctaatttttaaattatttgtagagatgggattttgccatgttgcccaggctggtctcacacaatccatctgccttggcctcccaaaatgctgggactacaggtatgagccactgtgcccggccttactattgttaaaatgtccgtactactcaaagtgatctatcagattcaatgcaattcctatcacaattccaatattatttttcatagaaatagaaaaaacatcctaaaattcacatggaatcacaaaacatcccaaatagccaaggcaatcatgagcacaaagaagaaagctgggctgggcatggtggctcacgcctgtaatcccagcactttgggaggctgaagtgggcagatcactggagctcaggagttttgagaccagcctgggcaacacagggagaccccacctctacaaaaaatacaaaaatagttggatgtggtggggcacacctgtagtcccagctatttgggaggctgagatgggaggatcacttcagcccaggaagcggaggctgaagagagctgtgattgcgccactgcactccagcctgagtgacagtatgagactctgtctcaaaacaagaacaaagctggaggcatcaaaccacctgatttcaaactatactacaaagctacagtaattaaaacagcatggtcctggcaaaaaaagcagacgcatagaccaaaggaacaatatagagagcccagaaatgaacccacgcatgtatggtcaagtgatctttgacaaaattgccaagaatacagaatgggaaaaggatagtctcttcaataaatggtgttggaaaaactggatataaaaagaatgaaactggaccaccctcatctcactccgaatacaaaaatcgaaatggatgaaagacttaataagacctgaaactgaaaaactaccagaagaaacagggggaaacccacatgacattggtctgagcaatgatttttttggatttgaccccaaaagcccagggagcaaaagtgaatacagacaaatgggataacatcaaactaaaaaacttctgtacagcaaaggaaacaatagtgtgaagagataacctatgggttgggaaaaaatatttgcatgctatacatttgataggggttaatatccaaaataatatggaactcaactcaatagcaagaaaacaaacaaacaaacccaattaaaaaacaggcaaaggacctaaataaacatttctgaaaagaagacacacaaatggccaacagatctattaaaaaaaaagctcaacatcactaatcattagggaaatgcaaattaaaaccaaaatgagatatcatttcatatctgtcagaatggctgttatcacaaagacgaaatatttagtgttggtgaggatgtggagcaaagggaagtcttgaatgctgttggtgggaatgtaaattagtacaaccctcatgtaaaactatatggaggttctttaaaaatctaaaaatagagttaccatatgatccagcaatcccacttctggatatttacctcaaagatttaaaatcagtttgtctaagtgatgtctgcattcccatgttcactgcagcactattcacaatagccaagttatggaatcaacctaagttgattttaaaatcaatctaagttgagtctatacagatcagataaacagacaataaaatgtggtatatacaggttgctccaaaatccaaaactgacatgacacgcaaaggaaatgctcatttggagcatttcaaagtttagatttttggatttgaaatgttcagccagtatgtattctgcaaatattgcaaaatctaaaaaattccccaaactgaaactggtaccaagtgtttcagattagggatattcaacttgtatacacaatggaatggaatactattcagccttaaaaacaagatggaaattcagtcatttgcagtgacatggatggaactggaaaacaatatgaagtgaaataagccagggacagaaagacaaatactgcaacactctcacttatatgtgaaatctaaaacaatttaactcatagaagcagagagcagaatggtggttacagagactggggggtgaagataatcgggagatgattaaagagttaaaaaagaaaaaaaagggaaaaaggaaatttagttttaactataacgatgtttctagaaacatctgacgagtacattcgtacctcatttctgttactaatcatatttaattgctcaaatcatgaagatactaagttgaaggtggctttgaaactcatttcaaaccagatatgccaagttttgttcaaattttgtttagaagtctacttactgctcgtcttagatatggagaagtaacataattaagtaaccagtcctggtgtttagtgctctgcaaacaaccaacagcaggggaatgaagcaaacgaaagatgtcttaacagcaaggaagcaatgtttcagcaccagaaaggccaaaagagggttacaatagccacagatcaaaaaggaaggttgggaaactccagagttcagttattagcttttttgttgttactaaatacattctaccactcacttccagctttaaaagtagagtttttccagtcttaacacagctgtaaattatattaatcaaagcaaataaatggttctatatcaaagatgtacgtaagaattgccgaagaacttttccaaaatgcatatgtctactgcacatatccctttcctatttaagaatcatagacaatttctctgcctcatatagaaagcaaacaacaacaaaaaaaaccccatgtatctcagggagtgacaagttctatgtgacaaagaaaagtgataaagtgggggttatttcaaataaagtagtcaggaagacatctctaaagagattatgttgaacaaagacctgcattaggtgaaggagaaagcacatccaaaggtccaaggtaagtatgagcttcacaagactagggaaagaaaataggattttgagtggaatagatgcaattaaaggatttaaaacggggaagtaatatgatttgattaacacttaagaccactcaggccactatgtgataatgtaacatgaagggagaaaaacagaagcagagaaaggaaattaggaggtcactgtattgatccatttgcgaaatgatgatggcatgggctataatgagttaatggaaaaagtaaaaagtggttggtattggattttttttttcttttttttttgagacagggtctcactctgtcacccaggctgtggtgcagtcttggctcactgcaatctctgcctcctgggttctagcgattctcgtgcctcagcctcctgagtagctgggatttcagttgcacgccaccaccccagctaacttttgtatttttggtagagacagggtttcaccaggttggccagcctggtcttgaactccagatatcaggtgatccacccacctcagcctcccaaagtgctgagattacaggcatgagctattgtgcccagccggtattggatatattctgaaggtagaacacatagaaacagctgatggactaggtgtagacaaaggaaaaagaattaagaattaacctaaaaggttcaggttctaagcttttagtctgaatggctgggtgaacagggggataatttacaaaaacaggatgtgtagggtgaaacaagcattctattttgaaaatgttacatttgagatatttatcagatatccaaatggagtcgtcaagcagacagttggacataaaaagttggattaagtatagagatgaactgaggctagagacatcatgggacttgatgaaatcccccaggaagagaggagggccaagggctgagtcctttttcaattaagaggaagggcctatctatttaagttctcattaattggtataagcaaaaagtaaacaataagggcaaggcactgctatagacttaaagctttagtttttcttcggtaatcaaagcatgcctaaaataaatatgccaacatacagttatatgaactgacatgtacaagctatgaatgagactatcttgccccagcgatctagggcaccctggctggtgaaagctgaaagccttcctctcaattgtgtgctattcaatggggttacaatgaaggtcctacagttaattaactataactccatcattcctggggaacaaatgcttgcctctctcaattcctcctgcttctttccctgtttagaatgtctgacttggggagctgtgcatttaatcactcccatctcttgaatacagcaaatacccagctctcctttaccttcactgagagcaatgcctgggattctgcacataccaactgcagggatctactgtaaagacacaggtcctagtgattttattacagaactgtgaaagagatgagattatactctgtttttttggtgtttgtattacctctgtttagcggaacactggcagcaaaaacaagtaaacaaaagcaaacctatagctttcattgtataggataaggaaattgtacaaaaagaactcaaaatattacttactaaaatggcattcaaaatccagcctccagtgacttactgctgttgaataaaggtgacaatctttggtgaaatctaaagagctattgtgcatagtgctagaagttataaccacctgcagacatttctgccgtttcattcgggcagctcagattgggaattggtgatgatggagaaagagctcttgggtcaaattactacactttggattttgatagtttaaggattttagtagccttaagagttctagacagacaagacagttatggataaacccctttggatcccatttctgaaagattcactcccttactgaaacacctgaccaagaattaagttagtcagccctgggtgtctgcaggttccacatgctcagattcaactgactgtagattgaaaatattcagaaacagcaacaacaacagcacaataaaaatacaagtaaaggacaggcacagtgactcatgcctgtaattccagtgctttgggaggctgaggtaggatgatcgtttgaagctaggagtttgagaccagtctgtgcaacatagcaagacctggtctctacaaaaaaatttaaaaatgagccgagtgggtggcacatgcctatagtcctaggcatgtgcccatatactcgttggcggggggaaggggcagggcactgaggtgggaggatcccttgaacccaggagtttggggttatattgagttatgatcacaccactgcactccagcctgggcaacagagcaagaccccatccctaaaaaacaaaatgaaacaacaacaacaaaaaaaagaagttaaaaaaatatggtataacaactttacatagcatttatattaggtattataagtaatctagaaacaatttaagtacacagaggccatatggttatatatgttatatgcaaacactatgccattttatgtaaagtacttgagcacctgtggattttggtatctgcagggggtcttagaaccaatcccctgaggacattaagggatgactgaatattctctagttttttccctaatctttcccttgattagtaattggccaacttctggggtttatgaagacatgcacttcaccccatgtcctaaatatgtgtagctatactcctagaacctctcacaagtgccagtgggagtcctacaaatcctgccctgaatttcagagagcaaaaggtgaagaaaaggaacatatcccagaaagcaatcacttcagaagaggaatttaccagaaaaggaagacaactggggactacaaacatactttcccacagtgggaggaagggcattcaaaggccagagaagaagataatctcatcctgccagttatggtcctacctgtcctgactccagcattcggagattgttttttttttttttgagacagagtctcactgttgtgttcttcacaaatattttcccctttcccccttttttttgtttttttgaaatggagtcttgctctgttgcccaggctggggtgcagtggtgtgatctcagctcactgcagcctctgcctcccaggttcaaacaattcttgtgtctcagcctcctgagtagctgaggttacaggcatgtgccaccatggccagctaatttttgtatttttagtagagacagggtttctccatgttggctaggctagtctcgaactcctggcctcaagtaatctgcctgcctcagcctcccaaagtgctggaattacaagtataagccactacacctgggcccccttttccctttttataactgcccttctaactattcctcaatcatcaatgtagaggcaatctcaacttgttccatctcattacctctcagagagggtcctaatctttccatcaattaattacattggatgcaggatgatccatctcttcaggcacttccgatattccagaatttttgctctatgatcaaatttaaagcaacattttgtttttctatgtcgactggcaaaataaaaacttgaggatcaaatggggctcaatttttcatgatattgtctcatgtcaggtaagtacttccattccttggtcaagaaaattctgacatgtgagtgggtccagaactatgaggtgagattaattacgcctttatctttcagccttacttcttaagcctgacattagaaatactttattaaatatcaagcaggatctactgccccccaaacaaaacagaaatgtggaataaaaaaaaaatgtcattttcttacagtaaacaactaatccactactaaaaactacatcttagcaaatccacattttaataaatcagatgccatctattaaccagctacactttatagttggtggcatctctatcatttatgattttctatagcaaatcaactcaaataaaattcctcaataagcaaagctttaaagtgtggcaagaaagaagcctgagattttattccaatattctctcattttgtgcaacaatattaaaaccttacttcagacagttcaccagctttacagaccaatgatatgggcccagcgcggtggctcacacctgtaatcccagcactttgggaggcagaagtgggcggatcacaaggtcaggagatcaagaccatcctggctaacatggtgaaaccccgtctctactaaaaatacaaaaaaattagccaggcatggtggcggccacctgtagtcccagatacttgggaagctgaggcaggagaatggcgtgaacctgggaggcggagcttgcagtgagccaagattgcgccactgtactccagcttgggtgacagagcaagactccatctcagaaaaaaaaaacaaacaaaaacccaataatatgccacaacaaagtgctctataaggtcatgccacattaacaacatgatatcatctctattagctttgaagacaaagtttttcaggaatgcagacagcaagaaatctatgacttaaaacaggttggaattgttatctgccctctttctcaagtttttcccagagttgcctgtgaatattaaatgttacttgaaatgagagcataatatgtttctgtttattcattaggtagtatacaaatatttattaaaccctgttgaataatgaagaaattgatctatgtccctttttcctggtaggaagtctctaaacccttggaatttccaagtgctaggtgtctttatccatggtgggtcccttggaccatatctaagtttatattaacaaagtgactcatgttggggccctatatagttggttttttcgatgtttcattcttgttgcctaggctggagtgcaatggtgcgatcttggctcactgcaacctctgcttcccaggttcaagcgattctcctgcctcagcctcccaagtagctgggattataggcatgcaccaccacgtctggctaatttttagtagagacagggtttcatcatgttggtcaggctggtcttgaactcctgacctcaagtgatccacttgccttggcctcccaaagtgctgggattacaggcacgagccaccgtggccagcccctatatagttttagatgaaagttggacatacgggaaagaccaaccacatgatcagaagactggggctttccaacttcccaacctccagggaagggagggaaagcttgaagactgagctcaatcacatggccaatgattcaatcaatacctaattaattacatctcaataaaactctgaatacttgaagcttgggtgagcatccctcggtggtgacacacatcaatgtgccaggagggtgaaagtcctgaggacacagaagcttcacatttagtacgctctcagactttcccctatgtgtcctgatttgtattctttataataaaactatagcaagcttagcactttctgagggggtaatgcaaacctcttaatttgtagccagttgattagaagtgcaggtggcttgtggatcctgaggcttgtggttagtgtctgaagtgagggcaatcttgtgaggaaccatgctcttaacctatgaagtctgtgataactctgggtagttagcatcagaattacattgtaagcaatcacccaaaatgtgtcaggcaatgaatccagacagttatacataacagccatgattcctgacaatatggggcttacaacatagaagagaaacaagtaaacaaacacgattagaaattgtggtgattaaagatattaaggagtataatacattttaagaaacaatgtaacacattccaacatgaggatattagtaggaaatcatttatcatcaactaaatctgaccactggaacagttgcttgccagaggcaaaatagccatttatgaatctatgaatgattgggattcacatcttgggagctgcaaaggtatctgaggagctgctgaattgtacaaaatgaagcagtttccaggggtttctttggtctgaaaatagatgagtgctaaaaatgcaaagatacttgtaatctcctaatcaaaaccaacaacacctcttagtagttgttttcattatttccccccactaacaatctgtagtaagaaacttttggttccttcacctaacaggaacttagcagtaaccaaatgaaatgccagacaggtttttgaattcggacctctctagacatagaatttagaatacctatggtaaatcatctgtgttacgttcttttctgctagttaatttgctggtttactgaaattagcaaacagggcaagatatgtaccacttaacaagtgaaagccaaggggaaaaaacattaccatgcatgccgtgctccaaatgtcagcaggggtattatagccagatccgattagaacttccaaggaacgatattgccttgtttgaatatcttcagtgaaatgtttgtgctgagaaaatgaaggaaacaatattttaaacttcattctaaaaagtaacaagtcaatactgcttaataatggagatgaaaataaactctctgaagtttttcccaaaccaaagttctcactttgcttatttcttaaacagcatttttatgttattagctccaacaatcctttgccttacacacagctactccaaattatttttacaaacaaatgagcctaaacttaatatacacaggtctaggaaacaacaacagcttttttctttttaaaaattgttttagtaaagatggggtctcgctatgttacccatgctggactcaaactcctgggctcaagtgatccacccaccttggcctcccaaagtgctgggattacaggcgtgagctaccacaccaaggaatccaaactctttaaccttgcaatttactatacttgtctttaataagtatctttctgtgcctttattgggatgttgatgttctacctagagtattttttgctcttttggtcaaatttcatctagtaccctttgaagccctggtgtatactagttttctacctgaagttttctctgagtaatttcctcttttcacaaatactgttccctgtttttaaatttcaataggattagagaattgtcttccacactttcctatcacatttgaatatttgaattttgtttcctgtatatgactcatactaagcttctttttgtccttcattattcatttattttttatcatggaaaatttcaaatatatacaaaagtagaaagaatcatgaaccccatgccatttattatactagtgtcacctagcaattaccactcattgccagtctattttcaactgtatcccaaccctgccaccacacctacaccagattttgaagtacatactagacattttcttttcattcataaatatggctttctgaaagatcattctttttaactgtgacactttgtcacctaaaaaaaaaaaattaagatgcaaaaccaaagaatcagagtttcaatgttgaaagtgcacatcaaatttttagtataagaggtgaaaacaggctgagtgaggcatatcactatgaaattatcttacagacttccactgggggaaaagtttcatataaagatcaagaatcagaatggcatcggtctttagtaccatcaaaactggaaactataaaacaatggagcaacgacattctgaaagaaaatgttttctaacctagaattctctacaaagccaactgagagtgaaagcagaataaagactatcagatgtgcaaatcccacccttcccccacccaatctcataccctttctcaggaaactattgcttgttgcatgtactctacaaaaaagatgacataaaccaagaaagataggagacacggaaaacaggggacatatatatagagaaaacaataaatctccaggatgatggtgaagggaaatcccaaatgacgtaatgtagcagacctatagggcaacccaatcagatcaatacagattagaagactccaggttctaggacacagcgctttagaaagataatagtagaaagaacactcaatgtatctgtacatattaaagtgtatttacaacactgggtaaaagtatgggattgaattaagtgatcaacagtacaaagaaaactaagcaagtgaaacatgttatgtagaaaggaaaaggaaccataatatatgctcagttcagctgaggatagccttagagtctcaatgatataaacatggtatgatcatgtagccaaaaattagattacattggggaaatgaggaattcgtgctgtggtgctagataagccccattttccgggaggaaaaaaataatatgtaacactgaaaacaaaattggattaatataacctgttatttattagtgatataaaggtaaatactgttaaggggagtgaaaaactggtgaaagaagtaggcagatttttaaataaaagcttatataactgtctcccccactgtgtacacgcatgattgataagcaaaaaaagaaaaaagaataaaaagcttagtacagtggtccatcagtgtacttcagggattagtttcagaatcccccgagtataaaatctgtgcatactcaagtttcacagttggcccagaactcaaatatacaaaaagccagcccttcatatatgtgcatttcacatcccttgaatattgttttcgatccttgtttggttaaaaaaatctgtgcataagtggacttgtgtagttcaaacctatgttgttcaaaagttgactgtatgtttaataatacagctcgttaaaaattatgtaaaattccattactgaatgccagatgctgatgtgctgaagagatcaagaagtgagatccaatctgaattcaatggggtgcaacacacatgtattgttcaccgctgtgtcctaatgcctacatcagagtatgtgccagcatgtttgctgaatgagtgaatggctgaaaagaacgtagtctttttttttttttttgagatggagtctcgctctgtcacccaggctggagtgcagtggtgcgatcttggctcactgcaagctctgcctcctgggttcacgtcattctcctgcctctgcctcccaagtagctgggactacaggtgcctgccacaacgcctggctaatattttttttttgtatttttagtagagacggggtttcactgtgttagctaggatggtcttgatctcctgacctcgtgatccgcctgcctcggcctcccaaagtgctgggattacaggggcgagccaagaacgcagtcattttaaatgcagagacactgctatggtttgaatgtttgtcccctttgaaactaatattgaaacttaatgtccaatgttaacagtactaagaggtgagaccttttagcctttaagaggtgactgggtcatgagggggtctgccttcatgaatggattaatgggttatcacagggtgtgaatgaattaacagagtaggcttgttataaaagttgaagagagattaattctgttgtgatgtaagtaacagaagactccaccggaataaagtgtgccacataggtaagaaaacacacatgaaggtgttccaaacataaaggcaccagagcctgaaacatggtgtgggcaggaaattggcaagcatttgatgtttgtacggtgtgatacttgttacagagtcaatacgtttctccacaatttacttgctaaaatatttattgagtacctactctgtaccaggcactgttctaagtactaaatatagatacagtggtaaaccagaaaaactttgttgtgatatgatgtacattctagtgagaggcttattaagcaaataaacatataatattagattgtgttaagtgttgtggagaaaaaaaaagttacagggagaaaggaagagtgagcaaatacctgagtgaatatgataaaggtataagtgtttggagagtggcggtttgctaattacattaggtgttcaggggaagagctccctgataagtgacatctgggtaagaacttaaagaaattgaaggagttgtacgtgaagaggattccaagcagaaggaagagtaagctctctttgcttggtggtgtgtgggccatggtaaggactttggtattcattctgaagggagccactgcaacgtttagcgaatatatgacttgacttacatttaaaatggctgactagacacaggtagtatgtgcctcatccacagaaaggaaccagaacagtcagaagatacccacattttgaacagattgtccaggaaggaatgctaagattcaccagagaagtgataggaagcaccagaaggaaagggtctgaggaagctggcatgggcatacagtaagagagaaatccccagcatcccacattctgaaaatgggttttatgatcttggttatgggagaaaccctgaaccaactagggcctcgggcctgacatgcagaactgcctaaagattggacagatgttgctccaaacagggaacccacagagaatcccacaggcatctgagtctaagcggcttcagctgggtgccattttgacagccttgataccagggatctgaagatgcagctgctgtcactccactgctctgaggaggaagaggggaggctaggcactctcatgcactcctgggagggtccctatcaccctgccatgggctgccggtgagaccaagatgtgagtggaccacattccccacagcttcttccccatgctgctggcctaagagggaccctccccgctctggtcccaggcataaagtgctattttgagaggttaatgctaggttgcgccttgccctttcgggctgacgtggctgcagctgccacttggctgaggagggacaggaaaaccaggctctcctatgcatacctaagacaacaggcttttttgagactgagacttgagtgtactgtaactccccacagtttcttgcccatgctgttcatttgagagggaacctaccctctcagtcacaggccaacagctggcaccattttgagagtttaaagctgggctatgcgcttgcccttgggcgacacggctgcaactgccacccagctgggagaggaacagcagagaccaagcttctctaagcacacttaggaaaatacccactgccctgctatcggtggctgtaaaactagggactagccccctccgacccatcacagctaacaacaacaacaacaacaacaacaacacagactgcttgcttgggtcccagcgggttgctccaccactctaactgccatcccccacattataccagctgcccaggggcctgagaacctgcccatatacccagtcagagacccaagaatcacacctccaggacccactaacactggaatcaacgctctggggcctaaaaacaggaacactcagcccactaatgccaccatcagggtccaaagactggctcagctggcatccaagtccccagcaaaacctcaccacaacctaaactgtaccctaagccacagaggaaattgcagatacccctgaccctgtgtactgccaaaaaagttatacaaaaaccatactaccagaggtacccaaaatcaaaatcaaaaagtatcttacttaaccaacaacatatatacaacttcagaaaaatattctcccctacaaaagcaatttcaaaaaaattggaacaagtgactactgcaacaaatgtgcagatatcaacggaaggacacagaaaacataaataaacaagtaaatatgacagcaccaaaggaccacaacaattgtccagcaacagatcccaataaaaaagaattccttgaaatgccaaataaatcaaaatactgattttaaagaagctcaataagatgcaagagaaatctgacaatcaatactaggaaatcagaaaatccattcaagagatgaatgagaaatttaccaaggtgacagatatcttaaaacaacaacaacaacaacaacaaaccccagaaattctagaactaaaaaattcactgaagcagggcacagttgctcacatctgtaatcctagcacttttggaggctaaggtgcttgagcccaggagtttaagacaagcctgggcaacatagtgagaccttgtctctactaaaaaaaattagctgggtgtgttggcatgcacctggggtcccagctactcaggaggctgagccaggaggatcgcttgagcccaggagattgaagctgcagtgagttgtgatcataccactgcattccagcctgggtgacagagtgagacaatgtttcaaataaattaataaattaaataaaaaatttattctaggaaatacaaaatacatttgaaagcctcaataatagactggaacaagtagaagaatctgagaacttgaagacaggtcctctgaaatattctagtcagataaatataaggaaataaaaaaaattagctgagcctggtggtgcgtgcctgtagtctcagttactcaggaggctggggcaggaggactgcttgagcccaggagttaaaggttgcaacaagccatgatgacaccacctcatttctacctgggcaacagagaccctgtttcttaaaaaaaaaaaaaaaattaattaattaattaaatgaatgaataaataatttttttttcagtttagaaaacctctttaagaaaatagtagataaaaatttcccaagtctaacaagagagttaaggcatccagatacaggaggcccactgatccccaggcaaatacatggggagggggaggtggagggggaggggagactttcccacacaaaacaaaagctgagggatttcaaaaaaaagctgagggattttatcaacaccagacctatccttacaagaaatcttaaagaagagagaaaatctttcttcaatcagaaagaaaaactcattaatgagcaataagtaatcatgtgaaggtacaaaactcaccagtaacagtaagtatacagaaaaacacagaatattataacaccgttaattgtagtgtgtaaactactcttaccctaagtagaaagatcaaccaatcaaaaataactacaacaacttttcaagatatagacagtcaaaaatgctgctgggaaaactggatacccatatgcagaaaaatgaaactcaatccctatctctcgtaatacataaaaatcaaatcaaaatagattaaagactgaaatctaagatctcaaactttgaaactactacaagaaaacatgtgggaaaatctccaggacactggtctgggcaaaaattttcttgagcaatacctcacgagcacaggcaaccaaaacaaaaatggacaaatgggatcacatgaagttaaacagcttctgcacagcaaagaaaacaatcaacaaagtgaagagacaacccacagaatgggagaaaatatttgcaaattacccatctgataggggattaataaccagaatatataaggagctcaagcaactctataggaaaaaaaaaaaatctaataatctgatcaaaaaatgggccaaagatttgaatagacatttctcaaaagaagacatacaaatggcaaagaggcatatgaaaaggtgctcaacatcactgaccatcagagaaaggcaaatcaaagctacaagagcatctcaccccagttaaaatggcttacgtccaaaagataggcagtaacaaatgctggcaaggatgtggagaaaagggaaccctcctgcactgatgataggaatataaactggttacaaccaccatggagaacagtttggaggtccctcagaaaactagagctaccatattatccagcaatcccactgctgcgtatataatcaaacgaaaggaaatctgtatataaaaaagatgtctgcactccgatgtttgttgtagcactattcacaatatttaagatttggaagcaacctaagtgtccatcaacagatgaattaaaaaaatgtggtgcatatacacaataaagtgctattcagccataaaaaagaatgggatcctgtcatttacaacatggatggaactggagatcattatgttagatgagataagccaggcacagaaagacaaatttcacatgttctcatttatttgtgggagctaaaaatcaaaacaatagaactcaaggacacagagagtagaaggatggttaccagaggctgggaagggtagcatgggagaagtggggagataaggatgattaatgggtataaaaaaattacttacaaataataagatctactctttcatagcacaacagggtgactatagtgaataataattatatatttaaaaataactagaagaatataattggattgtcgtaacacaaaggataaatgcttgaagggatggataccctattttactccatgatgtgattatttcacattgcatgcctgtatcaaaacatctcagataccccacgaatacatacacctactatgtacccattaaaaattaaaaattaaaaaaaattttaaaacaatcacactatccaaagcaatctacaggttcaatgcaattcttttcaaaatactaatgtcattttttcacagaattacaaaaaacaattctaaaattcatatggaataaaaaaagaacctaaatagccaaaagaatcctaagcaaaaagaaaaaagctagaggcattacactgtctgacctaaaactatacaaggttacagcaaccaaaacagcatgtattagtattaaaatagatacacagatcaatggaacagaatagagaacctagaaataaagccatatacttaacagcaaactgatctttgaaaagtcaacaagcacattcactgggaaaaagacatccttttcaataaatggttctaggaaaactggactgccatatgcagacgaataaaagatccctatcactcactgtatacaaaaatcaacccaagaccaattaaagacatgaatataagacctgaaactcatgactaagacctcaggcaacaaaaataaaaatagacaaatgggacttaaacaaaaaagcttctgcacagcaaaagaaataatcaagagtcaacaggcaacctacaaaatgggagaaaaaaatctgcaaactatatgacccaacaggggactaacatctagaatttacaagaaactcaactcaattaaaaaaaaaaccaaataatcccattaaaaggtagactaaggacacgaatagggatttttcaaaagaagacaaatggccaacaaataaatgaaaaaatgtccactatcactaaccagcagagaaatacaaattaaaaccacaatgaggtatctttcaccaatcagagtggctattactaaaaatacaaaaaataataacatgttggagaggatgtggagaaaagggacttcttacacactcttggtgggaatgaaaatcagcaccatctctatagaaaatagtatgaatggccgggcgcggtggctcatgcctctaatcccagcactttgggaggccgaggtaggcagatcacaaggtcaggagatcgagaccatcctggccaacatggtgaaaccccgtctctactaaaaatacaaaaaattagccggctgtggcggcacgtgcctgtagtcccagctacgcgggaagggtgaggcaggagaattgcttgaacctgggaggcagaggctgcagtgagcagagatcgcaccactgcactccagcctgggcaatagagcgagactccatttaaaaaaaaagaaaaagaaagaaggaaaatagtatgaaaatttctcaaagaactaaaaataaaactaccacatgatctagcagtaccactgctgggtatctgcacaaaggaaaataaatcatatcaaaaatatacctatacttgtatgtttatcacagcactattcataattacaactacggaatcaacccaagtgtctaggagtagataaagaaaatgtggtatggaatgaacacaatactattcagccataaaaaagaatgaaatcatgtgttttgcagcaacatggatggaactggatgccattatcttaattgaaacaactcaaagaaaggtaaataccacatgttctcacttataagtgggagctgcataatgtgtacacatggaggtatagtgtggaatgatcgacaatgaagactcagagggtggggtgaaagggtggatgaagggatgttacttggtggttacaatgtgcactgttccagtgatggatccattgaaggccctgacttcaccacaatgcaatatatcaacctagcaaaactgcacttatacctcatgaacatatacaaattaaaaaaaaaagtatcactctgatagatgtgttgccaatagtctacggggagcaagggcagcagaagggagaaagtgaagaagctattgcagtcactactgaagtcatccagggtgacctggaccagatgatagcgtagtggagtaattctaattacttggaaagctgctccacattcttattagtcagtgctaagctggctttgttttttctaaaaggttatcacaatattctacaatcaatatgggaagtaagatccttctgaggtctgaaccatgtcccatttaaaagcatatggctctttgagtactgtcatttatgtgtgaatcattctattataaattttaaaaagatgtccattaaaaataaccttggtcaggtatggtggctcatgcctgtagtcccaacactttgggaggccgagacgggcagatcacttgaggtccggagtttgaggctggcctggccaacatggtgaaacccctcctctactaaaaatacaaaaattagccagggcatgctggcgcacgcctgtaatcacagctacttgggaggctgaggcaggagaatcacctgaatccgggaggcagaggttccagtgagctgagattgagttactgcactccagcctgggtgacagagcaagactccgtctcaaacaaaaaaaccttaaaacactttattagatacacagtaaaaaacaacagtataaataattcgccaattaaaatgagattccactatttagcctgaagatcatacaagaaaatacttttctgagttgttaaaggtagaataactgatgtatcttttcttttctttttttttgagatgggagtttcactcttgctgcccaggctggagtgcaatggcgtgatcttggctcgccgaaacctctgcctgccaggttcaagtgattctcctgcctcagcctcccaagtagctggtattacaggcatgcgccaacacgcctggctaatttttttgtatttttagtagagacgggatttctccatgtggtcaggctggtctcgaactcctgacctcaggtgatctcatgtgatccgccagcctccgcctcccaaagtgctgggattacaggcatgagccaccgtgcctggctaactgaagtatcctttctagagtgtaatatgacactatacatcaaaaaacatataattatttctaattacatgtcattacgaataactaaaaataagttaaatgacactatacatcataaagcccttttaaaaatcacagaacttctgacttagcaattctatgtctaggacatgtcctaagaaaaactatacaaagatttgcgtgcagagtctcatcacaaagagctgtcaaaaatatgtagattaaagtgtactagggaaacaatgtaatgaactgaattgtatttaaatttctggctgacaaagcaaagtgtccaaaatatgttaagtgaattaaaaggaggttacaatttataagttagtcatcaattttgaaaatgggagtaggggagtatgaacataggcactgagtgtctgaaagttaataatgatatatatattaaaaacaagattggccaggagttgacattactgaatctgggtgatgggtatctggagtggggtggggtaacagaaggacttttcatgatcacgattaccattctactttcgtaagtatatttaaacttttccatagtaaaaggtttttttaaatgtaaaaaaatattcactgaagtgttgtatcaatctgggtacagaattatggatgttttgcataactaagtccaaattctcattcatcctcccagtcacttcaaaacaccattaaggcaagtttaacttaccacccaacaagcatttccaaggtcagcaatcttcaccttgagcttttctgcattttttggctcaaggggattaacaagaaaatttccagccgtggattttcctacagacaacaggcatcatcaataagactgttcaatgaacagagaaatactcaatgagtaataaagctctccaaggtaagagtaatacagtcagcaatacccaagtgacaacttacattttctgagacaaaaagagcacagcaacgccttgagtttccagaattaaaaacctctgccctcacagcaacaaatgaagtgctgtgtactcagtacatgatggataaagttagctacagattacaatttaaacgtaacttagacacacctgttgtaaagctatagttacaaaaacaatcatacttttagtctagaaatctgtgaatgtgttgtgcagggaaggagtgttgaggaagtatagctgcataggtacctttgttgtccagtggtccgttatgttcttgctcttgttcatcttcacagggtatctctgcccgaatgctttcttgaagttggctaatgtgttgttcactgaatgactgacctacagttgaggaagactggcacaccatggtgtctgacacctcagatgttataggtgtacaagagtctgtttcttgagatgtgctgctgtctccattttgggagcttaggaaactagattcctgattcaaattttggacatcacagtcattagcattatgtagatcctctttatgtctcaatgtttcattattactgttctgagtataattaatgacttcaatcactccattgcaattaatttctgctgcaccaccctctgtatcacgttccataagcgtttgatcctggccaatggtacttgactcttctaaggaacaaacgaacaaaaaaagatatatgcatatgtgtgtgagtgaaagaacagaaacatttctcacaagattaaaacattttctagaacttatactgagtgacataaaaacatgactaaacatctaaaacctatttccggaagggccaagatcttacttttacccaattgttaaatgaaatctatgttccatttcctgagaaaagttacaaattacatttaaatattacctgcctaacatttatgacaagatccatattcttataaagatacccccagagatgtgttgtatgtatgaaaccactgtattatatagcaatgataaattaacgttaaagtgtgttgtacagtaattttcgtgatgttctatttataccaagtttttcttgggtcattttattaggtgggttctctttcaagggtctttcaacaggactctctgattcttcttgcttgtttggtcttttttgcccagggcccgactctttctccatttcctcaatttcctgcattcgcttctctagtaattctgcctggcgcttctgcttcttcttcaatttcttcttcttattctttgacattttgtcagcctgggcggagattacaaacagataaagccttcaggtggctaattaattacccccagttggagatagttgttaactttaattacttcctaattaaatttcacaaatctttccctaacatagcacttaagtctttcattaaattaaaagatgcgggatactcttataaacccaaataaaaacagaataaataacaaagtgtggtcttctgagcagtccgtggggttggtttacattcagacaaactcgaattttttagaggcctcaccagtacaaatgtgatgaaggtgcatgggaatttactggagaaaattatagaagcgcaggaattttttttccttttggttctcaaacttgaaacaaactgttaccatccacaacagaagaacccatgcccatagtccatagatcaaaattaaatataaaaacaccttatacttactggtttaggctggggagcagtactgactgaaaagaaaagaaaaccaagtaagaattctggcattcatcaggcaatataaactaaggctcagataaaacactctaccagaatgaaaagtctttcttatgtagtctacattgcagagaaaactattgtttttaaatgacttaagtagaagctatattattaccatttttaaagaaaataatgaatagaaattgccaaacttaaaaaaaagggataaataaaattcttcctccccaggtaaactaaagttgctaaaaatcacctattttccattcccatgcactgcttaaaatagaatgggacaagcaacaacctcttcacctcaaatgctacccagaatctgtcagttttaaaaggggagtctaggtgacatcaagagctatagtaatttgctctacagcatgtcatggataacagtgtagcttagctggaaggtaggatcttcagtcttcctctttttaaaatattagtataataactgtggttaacaaaaaacacataataaaaatttatactctagataagtgtacattcagtggttttaacactattcacactgttgtataacaggatctgtagaatgttttcatcttgtaaaacagaaactacatccatttaacaaccaactccccatttcccccttctttagtcttcctttttaaagaagtgtataactaataactcaacttgaggatcaagcaagttcctaaaaaatgacacactactaaaactaaaatctgtatctcaaaagaaaaaaaatcataaagcagcctttatttatttatttaattttatgtcttagacagggtctcactttgttgcctatgctcgagtgcagtggtactatcacaactcgtggcagccttgacttcctaggctcaagcaatcatcctgccccagcctcctgagtaaatggactacaggcacgcatcactatgcctggctaatttttttaatttttgtagagacagggtcttactgtgttgcctaggctggtctcaaacttctgggcccaaatcatccacccacctcaacctcccaaagtgttgcgttacaggcatgagccactgtgcctggtcccgcaatttatttggtatataatattgtgtggcacactactaactgctttaccatttaatcccaataattcgcagttgagggaaaataaagtaaaataactcagctaaggtttctcagtctaggatgaagcccaaattcaaaccaagtctgtctactccagtgtttaaacctaaactattaatagcaatgttatcttgtccctctacagactaccagtcctataaatgagcatgtgtgatcacagttagaggtaaacacttcaaaaatcatcaactcataagaaaaaatatttttaaacaatacacaccagcttttataacatacaacacaaagacacaatatctagttttctccttcccctatggaagtaacagtgagaatgtctcttggaagctgataatgtttcttaaatatgttattgttgaaatggattgagtggtgtttaattccctggtaacagaataaaaatagaaatttctttttaacttctaatgatagcgaagtccctaaaagaaaatacacctgcagatccggaaggcggaggagctccagatcgctgccattctgttgcttctgcagccagcctccgaatgtactgctcattcactgacaataagatgttctctggtttaatgtcagtgtggatgatacggcacttggtatgtaaataatcaagaccctgtaacacctgaatggaaatagagtggcagacttgcaaacacaaaatacaggctttctggagaagtaagagattataacatgacattaaaaaaaaaaaaaagatatgatagcgttttctatagagaataaaagcaccttttaaaaaagcacaaataaactttctcagaaagattaaactatgaaaaaggcaagaaattatttacaataaaaaattcttcaatgttttacaaagctgattctatttggagatattcttcaactatgtacaatgcaaagactgagaataaacttcaacacacacacaccctctaagtgttgtaatgtaggtgctgacagacatttagatatctttaattcaaatttcctcactgaggaagaattgaggtctcttgctgcccagtttggagctctttccaggacatataatccaaacaaatttttgcaccttgaagtattaatattttcctgatggtaaaatctatactgtatattgaaggctctttagaaaattagaaaatgcctatgaatcatgctgtataaagagatggcaataatctgacatagcaattatctattcatgtaaaattactatttgcaaccagaacttctggataagggctccaatgttcccaagtcaggaacctcagcttccctttctaattattataggaggcaaacctgggggaaaatggttatgctaaaacatttaaaaagagaataagcacaataaattctaaaggttgaatgaaatatttaattttagcaattaactttttttttttttttgagatggagtcttgctctgtcgcccaggctggagcgcggtggcgcgatctcagctcactgcaacctccgcctcccgggttcaagcgattctcctgcctcagcctgccgagtagctgggattataggcgcttaccaccacacccggctaatttttgtatttttagtagagacggggtttcgcactgttggccaggctggtctcgagctcctgacctcaggtgatctgcccgcctcggcctcccaaagtgctgggattacaggcgtgagccaccgcgcccagccaataacttactttttaaaacaaagaattttaaaacaaaaattcttttttttttttgagacggagtctcgctctgtcgcccaggctggagtgcagtggtgtgatctcggctcaccgcaagctccgcctcctgggttcacgccattctcctgcctcagcctcccgagtagcttgggactacaggtgcctgccaagacacccggctaactttttgtattttgagtagagaggaggtttcaccatgttagccaggatggtcttgatctcctgacctcgtgatctgcccgcctcggcctcccaaagtgctgggattacaggaatgagccaccacacccggccttaaaacaaaaattctattggaaaaaataaagtcctgacacttcaagaatattaaaaaatcactacatagtcaagactaagatacttgctgattcaagatacatacttgctgaataatttttttgacacaaggcagtggaagcccctgataattggatttgatgatccacttgagcagatgatgccccaaaacttcaaataccatgcagatatctaggaattcattaaggagggaaaaaacggcacaaaagaagaacacggcaagacaagctgtgaattccaccctattaaatgttatgtattattttctttcagtataaaaagttacagagcttgaatgaataaatatgtagctgttaatattctaaaatttcaaagtctaatgctatagtcaatgaaagcattcatgaaacattaaattgtgggcggctggcttcatcaatattattatgtacattaaaatactcaatggtaaaagaaaaagtgaaacctacatatgcaaatagtgaaagaaagcagtaggctcaagcctcaagctgttgattagcttcaggtaaattagtttcttccctaatatcaaaattggtgtccagggtaaaaattcccactctcacagcttcaaagcaaggaaaaacaaattattccttaactatagaagagatgaatgtacaagaaagacttaaacctcaaaaacgtaaatgccaacatttttttttaaataggaaacttgcttaatgctctgtattttacaaaactaatcttgattccagtgccaccatgtgttgtccttatgtatgaacaacctgatgacaccacacagcaggaatactctgagtctaaaattgtgcagggcactacagagattttagtagtatcttgatgtcttccacccccactggcttctacatgcaagttaagacatacatatatagtaatggtctagtgctcagactttaacattctccattaaaggaaagcctgagctccttggaaaaatggccaaatccaaggtaggaaaaataacagggtaaacttggaacaccttgctgttctaacaaataaaagaacctgtcaggaagaaacaggaaccatcttgaaaaggatgtcaccagccaacatggagacttcttttttttttttttttttgagacagagtcttggctctgttgcccaggctggagtgcagtggcactatctcagctcactgcaacctctgcctctcggcactacaggtgtgtaccaccacgctgggctaatttttgtatttttagtacagatggggtttcaccatattggccaggctggtcttgaactcctgacctcataatctacctgccttggcctcccaaagtgctgggattacaagcgtgagccactgcgcccggccagaccactataaaggataaaattatgagttaatatatgaattaaaaacagaacaagtccacactgatctgaaagtaagtgtggaggcaggaggaagagaaacatcttctttagagaagaaagccaaataataaatacataagggattacagaaatagaaaatcaccatttttacaatcactatagtatactattactgattcaggtaagaatcagtgaatactaaaacaactatgtgaaagactgtcgggaaaaaggattgtcacagtgtcaaaatatcattccacagattgcttattaattacaaaaagaacaaagtacctttacaactgggaaatctggaaggcactgccttaaccaagtgatcaaacttactaccaccaatgataagcacaaattcacaccatgtgccttctaatgcaatatactaatatgcattcgaatgcatattctaatgcaataatccatgtactatgcttgacaaacacggttaacctgaatttaatcatgaggaaacaatcaaacaaatccaaactaaggtggcataaaacaactagcctggattcttaaattaaaaaaaaaaaaaaaaaaaaaaggcaatgtcataaatgttccaaactacgtaagattaaaagcacatgacaaccacaaacacagatcaaaattacagtaagatagcatctcaaactaataaatgactaaaataaaaaaactaaacatcaccaaatgtaggtgaggttgtggaacaattagaactcttgtattatgctagtagaagtctaaaatggtacaagcactttggaaaactgcttggcaaattcttaaatataaaacctatgacaggtcgggcatggtggctcatgcctgtaatcctagcactttgggaggccgagacagatagatcccttgagcccaggagttcaagaagaccagcctgggcaacaaggtgaaaccctgtctctacaagaaaaatccaaaaattagccaagtgtggtggcgtgtgcctgtagtcccagctacttaggaggctgaggtgagaggatcacctgagcccaggaggtcaaggctgcagtgagcagagatcatgccacggcactccagcctgagtgacacagtgacaccccgtcacaaaaacaacaaacaaaaaaccccagcacctatcaagttttctgctttagccaagatggagtaacaggcactggacttatcttattgaaaaaacaatactcaaacagaccaaatacaaaaacaacagaagactctggacatcagacaacaagtacagtgatccctgaaaaaaggaaacaagagctgaaccctgggattgccccatcttattgccttgaggctttccaggtagactccacaagttgaatcaatgggagctgagagtctggagagaccaaggcagctataattcactgaaaaaggtaccagagagaggggagagctgcagaaagagagaaatttggagatttgcagagggggcccgccccttcaaggattcagcaaagcacatgtgtgtgaggaaactagcagaggcagagaagaaaaaacatcttaaaggattatagagaacaatgcccagcattcgcatagggcttggaacagtgcctgttcccagcaaagagactagaaaaatttagtcacagggtattgggtaggatatatttgggaaggtcttgcctcagtagagggaatgattagatctggactgagcaatgctttggatccatctaacaaatcataaaagtaaaatctaaaaggataaaacactttccaagtaacatcacaccatcccagaacaaggctcaagaagatttatagaaatacaaaacatccagcagccaacaaggtaaaacttacaatgtgattaccaggtagtaaaacatatccaaaattaaaataatcgatcatgtgaaactgacttagaaccatcacagatgttagaattagacaaggacaataaatggttattatagttgtattccatatgttcaaaaaattaagtagagacatgaaaagtattttttagaagactgaaaatgggccgggtgcagtggctcatggctgtaatcccagcactttgggaggccgaggtgggcggatcacgaggtcaggagtttgagaccagcctgaccaatatggtgaaactccatctctactaaaaatacaaaaaaactagccaggcatggtggcgcgtgcctgtagtcccagctacttaggaggctaaggcaggagaatcacttgaacccaggaggcggaggttgcagtgagcaaccactgcaccactgcactccactgcactcctgcaccactgactccgtctcaaaaaaaaaaaaaagacttgaaaatgaacttccagagacaaaaagtgcaatgtgagagatcaaaacacactggatggaacaaatggcagattagattttgtagaataaaaagattagtgaatttgatggcacagcaacagaattagtccaaaataaaacaatttggaaaaataatccaaacaaacaaatccacacatccacaaaagcaagctttgggggcaactcaaatagtgacctccaaaaagggaagacaggaaggaggtgaaagtatgtgctttttgcaatgaatcaacaaatcataaaggtaaagattcacccagtagcaaagcatacccctaagtgcttagattctggatgtcatttcccactgaatggaattagggcttcttagagaaaaactgattctagatttaagacaggaaattcacaaggtgagcctgcaatatcttgatgccaggtaataaactgccaaaatgtcatacagatcctgactcaagtaagaatcgtaaactagagaagagtctgagaagatggtggagtaagaagccaccagaaatctgtttccccacctagacaaccaatgcattggcagaatctgtctaatgtgattcttaagaaactctggagtctactgagggctcacaacttcccgaagaagaggcttggataataattattgtaaatgttggtcaatttcagctcttagcacagtggcaaccacctatcccctaatcctatagcaagcagccctgcacacagtttgttggagccatggtgggcaaaaaggatcctgccccaagtatcagagtcgggtggccatttttgtaacccccctccattgttttaagcccctcttctggctcaagtgatcttgcaaagatttaaagggccagtgccctatttcctctccttcaatttctttctttttcccctttgggagccagacattaagactaggacatttacggccaggcacagtagctcacacctgtaatcccagcactttgggaggccaaagtgggcagatcacttgaggccaggagttcgagaccagcctggcaaacatggtgaaacgctgtctctattaaaattacgaaaattagccaggtgtggtggcatgcacctgtaatcccagctacatgggaggctgaggcaggagaatcacttaaacccaggaggcggaggttgcactgagctgagactgtgccactgcactctagcctgtgtgacagagactcttgtctctaaataaataaatagactaggacattcaaaagcaactgcatatagagggaaaatcagaaagtgactgcgcatgcccaggaaaagatgcagactgagcaaagacctttcgtttacatctcaggctgatccttggaagagaaagactacataagaaaaacaaatacaaaaacaaaacagagccaggtacagcggctcatgcacgtaatcccagcacttcgggaggctgaggcaggatgactgcttgagcccagggggttgagaccagcctgggcaacatagcaagaccccatctccacaaaaaataaaaaattagctgggtgtggtggcatgcaactgtagtctcagctatttgaaaggctgaggcaggaggactacttgattccaggacatcaaggctgcagtttaagtcatgactgtgccactgtactccagccttggcaagagagtgagatcctgtctcaaaaaaataaataaataacaaaccccatcaaaccttagggatatggccaaatctaatttccagagttaccatattagatttaaatgtccagttttcaaaagaaaatcacaaggcatatgaagaaatagttaagtacagcatattcaaacgacaaaaataaatcaacagatactgtccctgaaaaagacttgatgcagacctactagaaaaagactttaaaacaaatgtcttaaagatgcttaggccaggtgtggtggctcattcctgtaaccctatcactttcagaagccaaggcaggaggactgcttgaacccaggagttcaagaccaacctgggccacacagtgagactccatctctacaaaattttaaaaattagctgggtgtggtggcatgcacctgtagtctggaggcttaggcaggagaagtacttgagtctgggtagtcaaggctgatgtgagctgtgttcgcaccacggcactccagcctgggtggtgtgaagaccttgacagagcaagaccttgtctcagaaaaaaaaaaaaaaaagctcaaagaacaaaaggaagatgtggagaaagtcaagaaaacaatatataaacaaaacggagatattaatgaggataaaaaaaaaactaaaaagaaaccaaaggaattctggtgctgaaaagtacaataaccaaaatgaaaaaattaactagagggattcaaaggcagatttgggtaggcagaagaaagaatcagcaaacctgaagttagggtgatggaaattatcaagtgtgaggaatagaaagaaaaaagattgaagaaaagtgaagaggcttaagggacctgtgggacatcattgagtagaccaaatatacactgtggcagtcccagaagaagaatagaggaggaggctgggcacggtggctcacgcctgtaatcccagcactttgggaggccaaggcaagtggatcacttgaggtcaggagttcaagaccagcctggccaacatggtgaaatcccatctctactgatatacaaaaattagctgcgtgtggtggtgtacacctgtaatcccacctacttgggaggctgaggcaggagaatggcttgaacccgggaggcagattgcagtgagcggagattgcaccactgcactccagcctgggtgacagagtgagactccatctcaaaaaaaaaaaaaaagaaaaaaaaaaaaaaagaaaagaaaagaagaagaaatggccagacagaatatttgaaaaaaaaaacaacggttgaaaacgtcacaaattagatgaaagacatgaatccaaaaagctcaatgagcatcaagcaagatgaactcaaagacacccacatcaagacacattataatcaaacttttgaaagattaagagggaatcttgaaagcatcaagaagagtgactcttcacatacaagggatcctcactaagattatcagcaagtttctcatcaaaaatttttggaggccagaaagcagtgggccaatatatttgaaatactaaaagaaaaataatgtcaaccaagaatcctatattaagaaaaacagtatttcaaaagtgagagaaaaattaagacatcccatgtaaacagaagctgaacgagttcattaccagatgtgccctggaaatggtcaagggagtcctataaggtgaaatgaaaagacactaaacaataacacaaagccaggcatccatatgaagaaataaagattatcaatgaaggtaaatacttgagcaattataaaagctaatattgtaataatggtttataactcctctttttgttttctacatgatttaaaaaaccaatatgtcaaaaaataattagtctaaaagctagtatgattataactttggtttggtagaatacacatatagatatagatatagatatagatatagatatagatatagatatagatatagatccaactatatgctgtctacaagagactcactttagatccaaagacacaaacagattaaagtgaaaggctgaagaaaagattccatgcaaatagtaaccaaacgaaatcaggggtggctatactaatatcagacaaaatagattttcaatcagaaaaagttataagagataaagaaggacattatctatattaataaaaggttcaacataccaccaagaagatataacaattatagacatttacatacttattaaaagaccaccaaactatataaaacaaaaactgacagaattaaagggagaaatagttctacaataatagttggagattttaatgccacactctcaataatgtatagaacaagcagacagaagataagcaaggcaatagaggacttaacacaataaaccaatgagatctaatagccatttaacaggtatagagcttcagttttacaagatgaaaagttatgaagatggatgatggtaatgactgcacaattttatgttatgtgtattttaccacaataaagaaaaaattagaccaaagaggaagaagaacaagaacaataagaacaaccagtagtagcagtagtagtagtagcagtagtagtagtagcaatagtagtagtagtactagtagtagtagtagtagtagtagtagtagtagtagtagtagtagcagcagcagcagaagaagaagaagacaaaaagaaaataaagcacaagacatttggtgagattgaaacactgactagagaaacttgtgactaagaaactggtcacaatttttttttttttggtataataattgcattcaggttatctttttatttaacaaatctttttgtcagagaatgcatcttgttgtgccacccacactggagtacagtggcactatcatagctcactgcagcctcaaactcccaggctcgagtgaccctgctgcttcagcctcccaagtagctgggactacaggcatgagctaccatgcctggctagtatttttttatttttgtagagacagggtcttgctatgttacccaggctggtcttgaacacctcagctttgcaaggtgctgggattataggcatgagccacagtgcctggctaggttatattttaagagtccttgtcatttagaaatacattctaaaacaattacagataaaatgtttaagattggctacagaattatcaggaggtacagacaaaacaagattggctataagttgataactcctgaaatgggtaatggatctgtggggattcattaaactatttctacttctttacatttgaaatttaccaatgattctgctgagaaaaaaaatttccccacccgagatggagtcttgctctgtcacccaggctggagtgcagtggcatgatctcaggtcactgcaacctccgcctcccaggttcaaaccattctcctacctcagcctcccaagtagctgggattacaggcacgtgccaccacgcctcgctaatttttgtatttttagtagagatggggtttcgccatgttggccagtctggtcttgaactcctgacctcgtgatccgcccgctttggcctcccaaagtgctgggattataggcgtgagccactgcacctggccaggaaatttttttaaacaagcaattaaataggctgggcatggtggctcatgccttcaatcccagcactttgggaggctgtggcaggtggatcgccaacatggcaaaaccccgtctctgctaaaaatacaaaaactagctgggcgtggtggtgtgcatctgtaatctcagctactcgggagggtgaggaaggagaatcgcttgaacctgggaggcggaggttgcagtgagccgagattgcgccattgcactccagcctggccaacaagaacgaaactctgtctcaaaataaataaaaataaaaaagcaattaaataaaaaaaattatcaaaacaagattatttaaaatgcagattacttaaaaagactaaacataaaataggattgtaaagctattctcttatgtttctagcttccatctgcttaatttttatttgttgagagaagtattacaatttgaaaatgttttaatttgtaagcagtgatattaaaatgaccaaacatatagtagcttaaaaaaaaacttgacagaacatcataatcaagtggcaaaaaggaagagccaaataatttgagtgaaagaaagctaatgagtagcaatcagaagcactagtaattgaaatcacaaggttattttttttttttttgaggcggagtcttgctctgtcgcccaggctggagtgcagttggcgctatcttggctcactgcaatctcctcctcccaggttcacgccattctcctgcctcagccttctgagtagctgggactacaggcgcctgccaccacgcccagcttttttttgtatttttagtagagatgaggtttcaccgtgttagccaagatggtctcggtctcctgacctcgtgatccgcccacctcggcctcccaaagtgctgagattacaggtgtgagccactgcacccggcccacaaggttatatttttaaaaaaatctaatggggagacagtgtaaagaaaataacaaaaggctgaaaataaaaggcttatgttattgagtaagcacatttagggcacattatgaataagaggagctagcaaaacagacagaatacagcatgaaaaaaaaagtatcctaaagacataggaggtcatataagcagacaataatgactggctaatgtcaacattatatagagaaaccaactgtcctccttcttaatcattcttttcccctcaccctccaggcaagtagagtgagccagtttatatggaattctgtaagaactaactttctagtttagggccctttatattttaatatgagaaacgatagtggtccagagaaaaaaacgcctgaacaaacatacacacgaatgtggatgtactgctctgtgtgggtatgttatgttgggaaaacgggtagaggcaggagagtgacatgagccattactaacccttaacatagtgttttgagttatatcctttcaatctctaacagtagtaaataatgcaggagcaaagacagctgggagataaggatgaagaaagacaggaaaaaatggctaagaacaaatggagaaaagaataaaatagggaatcaatggacagaagctacagagaaaccacctagcaatgtttgaaaaatatcttgggggccgggcacggtggctcacacctgtaatcccagcactttgggaggccgaggcgggcagatcacctgaggtcaggggtttgagaccagcctggccaacatggtgaaaccccatctctactaaaaatacaaaattagctgggtgtggtggcatccacctgtaatcccagctactcgggaggctgaggcaggagaatcacttgaacccaggaggcagaggttacagtgagccgagattatgccattgaactccaaaaaagaaaaagaaaaatatcttggaacttgaaattcaaacctactaagatatttcaatagttaaaaagccttctttgcttagttagggtcaaataaaggtactcagcattactggggagatttgagagtatttctatagttttacttggaacttttgcaaattagtaaagaaatctggcacaatgacaaacattacaagattaaataatagaaaaaacagatatggccatcacgacaccctgtgtaggtttttaaaaaattacttggtttagaattcttaattctttgaacacacacacacacacacacacacacacacacacacacagagagagagagagagagagagagagagagagccatctacaaagtgaccacaataagcacaagatactgttttaagatggttgcagcagttttccttagacatctgggtaatctgtgatttgtatttttctaagaaatgactcagaattgactttagaacaatagtctttccacattatcagctgttctctctcctttcccatcccttccttcctgcttctctgttcaaatctcttcccatagtctacatgaaactagtcatatgtagtcctgtctcctttaaatacaaaaagatcaacagcaattaggaatgtgcattaaaggaagctaaacatgcatgaaaagtaaaataatgtatgaaatgtctttatacattttaaaaacagcttataaacaggtgattttagatttatccaatctaagtaagattcgacttcatcttttactgaaaaatctgattgacctttataagcacagctgttgcaataacctttccattagctcaccgcacgtcactttgatacctgtgaagaaaatcagctatggttcctttcaattctacagttctaaaacatccagataaaaacataaaacaagtcagtttttcattataatagaatgtgaacaattacacccttttagactctaaacataaactacattcacagcctcttcaaagttgaggcttagtataataaatacaatcataccttaaattgttcatccagtttctttcttcctttctttttctttctctctttttctctttcttttagacagtatcttttttttttttttttagacagagtctggctctgtcccccacgctggagtgcagtgggctcaatctcggctcactgcaacctctgcctccccagttcaagtgattctccagcctcagcctctccagtagctgggattacaggagcctgccaccatgcccagctaatttttgtattttggtagaaacagagtttcaccatgttcgccaggtgggtcttgaactcctgacctcaggtgatccacctgcctcggcctcccaaagtgctgggattacaggcttgagccaccgtgcccggcctactcagtatttttcataagaaattacttcccttaaagtttctgtgctaactgacaaaaatcatagactctttacttagtgatacaacgcattttctaaaagtttcctttgatttcgctttaatttgcctgaaaagaggacaagaagcttaaagcaatattctgaaaaatcacaccacacaaaattagacaaaattcagatgtgtgttcagaagtgtacaataaaagaggtaattttattatagtttgccttagaaaagacaccaaggccatctacacaacaaatctagttcctttctttgggattgggatgatttattctcaaataggtttttaaaaggatacgtgttccattaactcctgatattttaaagtcatctagtagttgaacaaccatttctctatttggatcattagggtctgaattgcgaacctgtagtggggaagagacagtgtttagcacaaggtaaagcatggaaataaaccagatggtaggggaagaatacttacagcaaattaactacaagaaagagctcacataaatctatttttaaaatatactaaaatttcaatagctttaatggagaaaaatcttaaatagtcaattcataagaggaaatacaaccaacaggaactatttttctaattaaactattttgctccctgatatcaatcaaagtgtggcctccaaattaactgatgattaccaggctatgaggaactaagaagattttgcaggatgcaaatcaactacagcactaaccacactgtttttttcagcggacattttttttttcatggaaaaactttctcaatgaagaaaacagtatgttgatttacttttgggtaggtacaaggctccttatcttgtcacaaacggacattctgaaaagtactgtcttaagccagatgcagtggcttgtgcctgtaaccccagctactctggaggctaaggcagatcacttgaggccaggagttgaaaataaaaaagaaaactactgccatagaaatctcctggtgcaacattctcactttatgaataaaaaatctgagactcagaaagaaaaaaatggtaacatggaggacataccggggtaaaggcgacctaaacccaggttttctaattctgaatttaagttccttctaccacactggcatattcctaatttaaaacagaactaaaaatacatttttgatagaatttatctcagtttccaggtataaatggaatcagtaaatacagtatttttatattatgtattctataacatatttgaaaaacaacaaaaaagatgctatacatttatttacacaactttccttttaaccatagtaggaaaaaaaaacattatgacagtagctacctggcctgtaaaacatgctcagtgaatatttttattcatttgaaaggtttttttttggttcatgcgtgtaagaagaattctcatcatagcatttgccaccagttccctactacatgcatggtatgtgtaaatattgttgtcttcctttacctctttaaggttactagaactttatagagaaaattatccatgctaaagagcctccacttggtgtgtttttattcaatgaaacttgatttatttataattcttcacattcatacatataatctaatactcactgacttcagcaaccggatttcatctagtgctgtttcagtgtaatgttcagcacttttaactactttcattgccacaaatttcttccccctaagaaacaaacacaggcaattaagactacatagcctacccttactttaggaagctaagatttagctataagatggttaaaaaggacaaatattgatttcacgtttccctgtagcccaaacaagctacttctatgggaacatttatacttgttaatgacactaactggccagatttcatttataggaagaataaaaaatctgttctcagataatctcagttgttgaacattttctctgagttaaaatccttcttttgaatatctccctgagttacaagcaaaactgcaaaatgaggataaataaggggaaagatattaccaaattccaagtgttctgtgtatatatctgtatataggcaaaaactaaaaggttaaaagctgtaatattttcccataggcagccagaagaaatacttcggtgaaaagaaaatgataaaaatcacaaaaaaatcaaacgacaaaagctttaccagcattaatttaatcactcctgtctctatagtagaaagggagatatataatactgattcttcacgaaagaaaagtggtttctccaagaatacagagactattgccaacaacaaaattctgataaatgaatcaggctagagatagattgaagcctggatcagcagtggaaactcagacaaacacatttagacatcatctaactaattcttttacagaaccactaaaacttactgaatatcccatgataaccatactgttgaaaagtgtccccagcctaactttcggatcacatggtatctcccattgaatagatctccaattttcacaagatgataacctcctggaagaaacaggggaaatacaatcagaaaaaccaggatgagaaacaatggtaagaaaaggcatttttaacatcacatttttcaacatctatataccttttatcaataaaaagtttcttttatacaatcaattcaacagaagaaaatcttaatagtcaaatcagccacatagtattactgaattcatgttattaaaaaaagtgagtaagattaatgatttagattgagcctacaacagtctcatccaaaaacaataaaaaggttgtatatcatgatattcttgtctctcaataattcaataggtttatctaaacatatatatctatttacaattacagtctcaggtgttttttaggagacagaataattctgtttatttagcaaaaaaaaaaaagcaagtaagcaaacgggattttctctaaataaaaacaaaacaaaacagcccaggcacggtggctcatgcctgtaatcccagcactttgggaggccaaggagggcggatcatttgaggtcaggagttcgagaccagcctggccaacatagtgaaacctgtctctattaaaaatacaaaaattaaggctgggcatggtggctcacgcgtgtaatcccagcactttgggaggccgaggtgggtggatcacctgaggtcaggagtttgagaaccagactggccaacatggtaaaacccagtctctactaaaaatacaaaaattggccagtgtcatggtgcatgcctgtagtcccagctactcgggaggctgaggcaggagaatcgcttgaacccaggaggtggaggttgcagtgagctgagattgtgccactgcactccagcctggatgacagagccagactctgtctcaaaaaacaaacaaacaaacaaaaaacaaaaaacggcaaggcgcggtggctcacccctgtaatcccagcactttgggaggctgaggcagacggatcacaaggtcaggagatcgagaccatcctggctaacacggtgaaaccctgtgtctactaaaaaaaaaaaaaaatacaaaaaattagccgggtatggtggcgggcgcctgtagtcccagctactcgggaggctgaggcaggagaatggcatgaacccgggaggcagagcttgcagtgagccgagatcgcgccaactgcactccagcctgggcgacagagcgagactccgcctcaaaaacaaaaaaacaaaaaatcccaaaaattagccaggcgtggtggtgggtgcctgaggcacaagaatcgcttgaatccaggagtcagaggctgcagtgagctgagatcgtgccacagcactccagcctgggcagctctgtctcaaaaaaacaaaacaaaaaaacccccaaaaaaccagaaaacagaagaaggcctgaaaaggctgccaacagtggcaagaatcaaggtattttcatatttatctttgtcagctgagaataagaaggaccacattcttctagatggtatgatacattccattttgtgttcctacccaaagactctagaaagtctcatcaagaaacagaaaagattaacaggcaacctaatgacaccatttaagtgtctgtcattccagtttaacttaacagccatcactatgagaaaaaaagtggtaagaaggtattttgtaaaaatctatatgccaaaatgttatcactggttatatgtggctgatagcattgcagaagtcttttactttcttttctgtttaacacagctctgaaattttctaaggtaaatatgtattataatttttaaagaggaaaaaggtaaaaacatttaatataaaattaggctttgataaattaagtcagactaagaacaaatactatttcctatgttttagagaaaaggatacaagtaaacagcaataaaactgtgtttatgctgatagatcaaacatccaaacgagaaattgcaaatagatggctcatgtctcacttcatacctctttatgaacttacctttacaataatcattaggatcttcttgctcatcatcatcagatcccagaatctcctcttcctgctctggtagatcactctcagagtggggagcagagcctcggtgctgagtttcagatctaagaaatgatacaaaaatgcccattccatttggacagaagaaaataagacattatcaaatgctgccctccccacaaaaaactaaactttcagataatatgaacagagtattaccaagtggcagcctaggaaaatattagctgtagttttacctcatgttagaaaaatactttttaaaaacttcagtacataataaataaaatctgaaaaatattaaaaagtacaaaggagaaaaattacttgaatctcaatatccaaacataatcactgataaactactgactcttcttccattatgttgctgtatcttcataaaaatatttatctgtaatcacatactacataaacaaatttgcatctggctttttctattacaaacttttttcatttctatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaaggaaacaaaaaatttgcccagcgtggtggtgggcaccccacgctgtaatcccagctacttgagaggctgaggcaggagaattgcttgaacccgggaagtggaggctacggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggataatctttattctgtaattagaattatttccctaaaattaaactactaagtaggggttaaaacattcctatttataaaaataacatgttaaatgtggaaaatttggaaaacacttgtttcaaggcatacctaatcagaacaactattaacattttggaatatttccttctagtcagtggccatgaatgcttcgcttctaatgatttttatgtagtatgactgcttcccaaaaaggttgtactaagttacatccccaccagccacacatgggcttttggtatttaagtactacctcattctgaaaacttagcttatttgataggtaaaaatcatatttcattttataatgcattaaaaatatttactgatttccttctctatatgtcttcaattagttatatcacaacttttgtgcactgagaagttcaagcagcataaaaacctgaatttacactcaggctctgacacttattagttgcctgtcttctaggacctttaagcaaaaaaagcagggtacctctgggcctcatgcctgtaatcccagcactttgggaagctgaggcaggtagatcatttgaggccaggggtttgagaccagcctggccaacataaagaaaccccatctctattaaaaatataaaaattagctgggtgtggtggcaggcacctgtaatcccagctacttgggaggctgaggcacaataatcacttgaactcaggaggcaaaggttacagtgagccgaaatcgcgtcgttgcactccaccctgggcaacagggcaagattctgtctaaaaacaacaacaacaacaacaacaacaacaacaacaacgacaacaacacaaaacaaaacaaaacaaaaaggcagggtacacagcattcctttcaatagctaaaggaaaatacatcttaattttaatttttcagtatttatttaccttttcatcaacctgtttcatcagattattttttcaaaagattcaattaacagaaaaacattttaatagaaaaaccagttacatgctatgactgagctatttaagacataagaaataccttgatgcaactaatgatttagatttttggtggccattccaaccttcctcaattcttgattttctttttaatcccccagggtacacaaaattagctataaaactgcatgattcaatgttcattgtaactgaaaacatgtctttgggaaatttatttagtaatacactggcccactttcctaagtggaaataaggagtctgaatgaagaacaacattctccaatttgagattaagatggaattctgaaacagattctctgattcaaacttaatgaaagtaaatgaaatggggccggttgcggtggctcacacctgtaatcccagcattttgtgaggccaaggcgggcagatcccttgagcctaaaagttcaagaccagcctgggaaacatggtgaaacctcatcattaagaaaaacgcaaaaattaactgggcttggtggtgcgtgcctgtagtcccagctactcggggaactgaggtgggaggaatgcttgaagctgcaaggttgcggctgcagtgagtcatgactgtgccactgcactccagcatgggcgacagagcaagaccttgtctcaaaaaaaaaaggggtgggggatgattaactgaaggcttgtataatggagttgacaccatacactgcacagcagacagactggtatttatcttgcagggggcaaaaaaggaggcctattctctaaagaaaataaaataaactggaaagaacaaatgctgttagtgtggatgatgctaccccagagtaaacttttccagattctggcattcagtgggaccaaacatcacacaggtagcctcctatttactctaaagaaaaagctggccaggcacggtggctaatgcctatagtcccaggactttgggaggccgaggccaggagttcaagaccagcctggccaacatggtgaaaccccgtctctactaaaaatacaaaaattagccaggcacagtggcatgcgcctgtaatcgcagctactcgggaggctgaggtgtgagaattgcttgaatccgggagacagaggttgcaatgagccgagatcatgccactgtgctccagcctgggcgacagagcgagactctgtctcaaataaaagaaaaaaaaagaaaagaaagaaaaagccttgctagggacgtagggctatcaatcaggtctctaatgcctcatccataaaaataaaaggtgactaaggatcatcgaacatttgaggaaagcccacggccccaaagacagagaccaagataagcaattggaaaactgaccctacaagagagatatgcattcaggagaaagaccaaacttaaaaactagttaatatgaatagagaaatgttaaatgatgccgatttccatacagactatgatgctctagtctaaaagatgagtaaagtcagaaagaagttctagaaaataaacttgaccattccctaaatgtaggggggaaaaatgcccacttatctcataatcgcccattatcccgtaatatctctactcaagataataatgctcaaaaagagatgagacaaacacaatcaaaccagaagttcccacatctgaataatagagttgcagaaagagaaacttatgaaaatagaagagataaaattattaaagaaattcaagaaatttctggagattgaacggaagctctacttaattttttattagggaaatttttaaatcccagtgttaagaagactctaaaggcttctaggtaaaaaaagctagaagggcagtaattagactgtcatcatctatctcatcagaaagccaatacactaaaagacaatgaggcaatgacttctaaattctgaggattttttttttaacctagtctaagtatcaacaacatttgagagcagaataaagtttttcaaatatggaccaacattgaaacttatctcccattcatcttctctgaagaagttacttaaagtcaagaaaacaaagcagtaaaactgagaaagaagacataggatccacaggattctgttttacagatcaaaaacagaagagccaaaaaggaagttccaagagcacaactatagagaaggcctgaaatgcatttaatctgacctagagccagagaccagagagctctgagagattccggggaaaaaaacaaagacaagaaagtatgcttgagacatactttctggaggaatctaacaatatgataaaaaagaggtaacacaagggagaaaaacataattacgaattccaagaaacaaacaaaatctaaacaaaaaaagttatgtaattatagcacaagacacagtcaaaataacataaatgcagattattgattttctacttcaaaatcaacctaatgataaagcacaaaatacctaattatggctacaaagtagaacgtaaggattctttgtaaacactgtaaagacagaatttaggggccagttgggagagaaagaaaagtccaccaatattttcatgttacgaagttaaagtgcctacagttaatgaaaccaaaaacaaaggttgaggcatatgcttgtgtgtgtgtgtgtgtgtgtgtgtgtgtgtgttcatccacagttcctggctcgtaactcccacagcccttgttagtcttttgttataatgttggggctctttaggcctcaaaagcaggcctcagaaaacagacctcctgccctctttcacctgctcctttttcttcccaatgcagtaacgtaatcctcccgtgcctttccataaagaaattatctgacctaccttatctgatcctgattcataagatccccatttcagagccccataccttgggggaaggaatgatgcacagagaggccaagaatctgaacagacaggccctgctgggtttccatactcagtctattaggtcgtactctttttgtccaatcacatttctacacagttgaccatgctttgttcatgcctatccaatgaagtcttcatgaaaggcccaagagggtgaagtatggagagcttccagacagctgaataagtagagattcctggagggtggtacacccagagagggcatggaagctctgcattccttcccataccttaggccctatgcatctattcatctctatcctttgtaatatcctttatttagaaaaaccagtaaacatgttgccctgagttctgtgagctcctctagcaaattaattcaacccaaggaggtgtcatgggaaacacaatttatagccagttgatcagaagcacaggtaaaacaacctgggcttgcaactggcactggaaacgggggagaggcagtcttgaggagtgaaccctcaatccgtggggtctccaagaagacactgtcagaactgaattgaatcagaggacatctagctggtatctgctgcagaactgattgggtggtgtatggcaggggaaaaagtctcatacatttggtcacaggagtctgtgttcattgttgtggtgtgagagcagacaacaaaacagtttgaagttttcctactcaaggtatattaaagttataaagtaatcaaaatagataataacaagtgttggtgaagaagtgaaaaaaactggaacccttacacatcgctggtgggaatgtaaaatggcacaaccactttggaaagtttgttaattcctcaaaatgctaaacattagaattaccatatgacctagcaattccacttctaggtatttaccaagagatgaaaacatgtatccacacaccaagttgtacatggatgttcacaatgcatagttgtatgattttgttaccagtagtgttaacctgaatgggatctggttaccttggaaatgcaggaacttattatgaatgtactataaagtaaaatgctgactgattcctggggacagggtggaatatacaaatacaacattattcataataaccaaatagtggaaataatccaaatgtccaccaactgctgagcggataaacaaaattcatatatctatacataaaaaggaatgatgtactgatacctgctttaacaagatgaatgaaccttgaaaacattatactaagagaagccagttacaaaagaccacataatcctaagattttatttacatgaaatgtccagaaaaggcaaatccattgagacagaaagtagattagcggttgccagggtctgagtaaagcgagtaatggtgagtgactactaatgggtttggagttttcttacaggaggataaaaatgctctaaacttagatcatggtgagatataacaattctgaatatgttaaaacaatggaagtgtacactagatgggtgaatttatggcatgcaaattatgtctcaataaagctttagaaaactaggtccaaatatagtgctttattgagaggaagagagagataaagtggtgatagtacaagtgaactatatcttcctcaatcatagcaagaatttatggtaatagctaaagctgatcaatcaaagaatagcagtaagtatgctggagatgtgcacgtctatccaactattaataaaataaacaaaaagcaatgggtaaaagtagttgctttaggaagtagacctatgtctagggaaaaggtgagacagaggactatgtagcagttatttaattaattcattaattcattcatttatgagacagggtctcactctaccgcccaggctgcagtgcagtggtgctatcacggctccctccagccttgtcctcctcagttcaagtgatcctcccacctcagtcccaagtatctgggactacaggcgtgcaccaccatgcctggctaatttttaaaattttttagagatgtgatctcactatgttacccagacaagtctcaaactcctgggcccaagtgattctccagtctcagcctaccaaattgctgagattacaggcatgagctaccacacccatcctgtagcttttatttaaaaaggcttccactgcgtattctattggaacaaattagacacctaaatgtccaacaagaggtgggttgaatagatttattagctgcatagatcacctgtatgtttatttaaatttgattaccaatttgttcatgtaaggtaaaacctgtaattgctaaaaggatcatctatgcaggccaattgatcaatacattgcattatgaatgtttactatatttgaaaatgtatccatgcaatgaacttttaaagtatttataacagcacaattctcaattccaaagatatggaaccaacctaagtacccattgatcaacaaacagataaagaaaaatgtcgcatctatacaccatggaataccactctgccatgaaaaggaatgaaatgtcttttgcagcaacttggatggagctggaggccattattctaagcgaagtaaatcaggaatggagaaaagcaaatactgtatgttctcacttataagtgggagctaagcaatcaggacttatagatatacagagtgatataatggactctggtgacttaaggttggggagaagattggggggttagggataaaagactagatattgcgtaaagtgtacactgctcaggtgacaggtgcactaaaatctcagaattcaccactaaagaactcattcatgtaataaaaaccacctgtaccccaaaactactgaaataattatttttttaagttatgtattactatattttttacaagttaatttatcacaaaatttagccatgcatggtggcaggcatctgtaatctcagctacttgggaggctgaggcaaaagaatcacttgaacttgggaggcggaggtggcagtgagccgagatcatgacattgcactccagcctgggcaacagaacgagactccatctcaaaaaagttaatttatcatattatcaggttcttccagtgtcaagcatgccttcttctctgttttccctaaaacctccctcttaaagccctctgaactccagttcacattttccaaaacaaaacaaaaatgtcaacaaatcctacacagacaccgggcgtggtggctcacgcctgtaatcccagcacttggtggccaagacaagcggatcacctgaggtcacgagttcaagaccagcctagccaacatggtgaaaccccgcctctactaaaaatacaaaaattagctgggcatggtggcgcgtgcctgtagtaccagctactcaggaggttgaggcaggagaatcgcttgaacctgggacgtggaagttgtagtgagctgggatcgcaccactgcactccagcctgatgacagagcgagactccatctcacaaacaaaacaaaacactggtgatctttaatgaagcacaattaggcaaccactatactccaaacagatttttttccaatggcctacaagaccttacgtgatctgtctcttcattgccccctccaacccatctctctatacatatcttcttaggcttgtgctaaagtggcaccctttcagagaacttccttgactttcctatatgaaacagcagtgtttgccacatgccctctgccactccccttaacccgctacttttcttcagcacttggcattttattgtcttcctccagacactcccagaatgtaagcttcatgagggcagcctttttttgttcaatggcatatcctaaatgcctagaaccgggatgtgtacaaggtatttctctttcgtatttagttattattcattcttcagttaaagtccattacacatctgcccccaacagaactagactgtgaagagccttaaatgtcaagcattgaagcactttacaaagaaggaagtgcagccattagagtggccctacagaagaaatgctttagaaagattcctttggggccgggcacggtggctcatgcctgtaatcccagagctttgggaagccgaggcgggtgtatcacttgaggtcaggagttcgagaccagcctggccaacttggcaaaaccccatctctactaaaatacaaaaattagctgggcatggtagcgggcacctgtaaccccagcaactcgggaggctgaggtaggagaatcgcttgaacctgggaggcagaggttgcagtgagctgggatcgcaccactacattccagtctgggcgacagagcaagactccatcgcaaaaaaaaaataataataataaaaaaataaaaaaaaataaaaagattcctttggtaaggtttgtaaaatgtaggggaaccagaaagcagagatgttggggaccactgcagagataatagttacagcaaaggtctctggagtcaggagacttgagtttgatcctggctccacagtttaccagagctccaaaactctgaacaaactgttagtgtaagaagctctctgcgcctctcgccttatgtgtaaaatgaaggcagaaatgatgcctacctcatagggcatttgcgaggatatgttattcctgtggttaatacagtgcctgaacataaattttagcattgtaggtagaaaataaaagaaaagaaacaagcaagtatgtgttcatgtattcaacttagttttactgagtgtctgtagatatcccaggtacttttttctaggcactgggaatgcagctgtgagcaagtatagggtccctgccttcactgtgtttacattctagcatgaagtgacaaaaaatagccctaatttatctgaacctatccggttcttgagttttagctggtgaacagcagaagttgggacagcaaagtcctatctcagtctctccaggagatacatgctctacaatgtcaggctatgaagagagctatagagaaaaattaagtagggcaaggggacacagtgtgctcatgctattttaaatagtgttgtgacatttgagtaaggaggtgagcgatgctgggagtttatctggaatgattcaaaacggtggtttcagaaaatggaaatttagggagaggaacggatttaaagatggtatgtttggggttttagaaatgatttagttatggctctaaaggatggattaaagctgggcatggtggcacacacctgtagtcccagctactcaggaggctgaggtggaagatcacttaagcccaggagttcaaggccagcctgagcaacacagtgagatttccatctcttaaataacaaaaaactaaaaattaaagagagaaagaaggagagactaaaagctgactggaaaaagcacctttgaaactttagtttacttacatataaactttagtcttttctgtcttgggagtggggaatggttaagatctcctaatgcagggaactgccttctgaggcctgtgttagaggctgaattgtgcccctcctagaaagatacgttggagtgctatcctccaataactgggcttgtgacattatttagatacagggtgggtcttcacagaggtaatcaagttaagatgaggttatcaggataagcccgaatccaacatgactactgtccttttaaaaagagaaaatctggatgtagagacacacacacatatagagggaagatgatgtgaagagacacagggaaaagatggccatctacaaggcaagaaaaaggcctgaaacagattctccctcacagccctcaaaaggaatcaaccctctgacaccttttagacttctagcctgtgagataataaatttctgttgtttagccacccagtttttggtactttgttacagaagactgaagaaaaccatgtttgtatacttatttcccttaagaaatcctaagtctcttgaaggaaaggactgtgtcccagtcatctctgtatcccttctagagttatcacacttatttagatgtgatgcaaagatttaacgagatgctattttaggttctagcacctacacacaatggaactcaataaatgctaaatttctcccactaccttttccatatatatttttcctgaaagatttttttcttttgcaaattgacataatcctttacatatctaattttatccaaacttaacttctgagacatactcacaagtagtctaagtttctcaactcagaaatcttaagctggaactagggtctaacaatataaaaataaaaatctgagtgcctaagtttatcaggtgttacatacaaataaatataattcaaccttgatcctcaggtgactatactccaaactctaccatatatacacacacatatatataaatatacatgaaaatgaaacaccaacacatgagctaaaactattagtttgatacactaatagtattaagaaatgtcacataggcttggcacagtggccccatgtctgtaatcccagcactttgggagaccaaggcgggaggaatgcttgagcccagcctgggccagatggcgagactccgtctctacaaaaaaaaaaaaaaaaaaaagaaaaaaaagattagccagtcttggtggcatgtgcctgtagtcgcagctactaagggagcagaggcaggaggatcccttgagcccagcagtgtgatgcagctgtaagctatgatcacgccactgcactccagagcctgggtaacaaagtgagaccctgtttctaaaaaataaaaaataataataaaataaaaatccaaaaaaaagtcacataaaagacaaagataaacccatctaaggtaaagaacgaagcatgagaaagaaagcagtcatccaaaaacttatttcacctcagtactgggctaggcactcaatgcaatttcatccttataaccttgccatctacagataaggcaacttgaactgaaaagtcaaaagaaactgtccatgttcacctaacaatggtgttggaggcaggctgaaatccgggactgtgtaattcaaaaggacaagctctttttgataaacagcatattgagcatgtactgtattatccttctacctagaaatattagcatgaattacctaatttatcccactgcattcttctttctagtaaagaaaaatgcaaaatacaattcctgttaaagctattctaaaaggcataaaaactagcagaagggagcttgtcctcaagctcatatgtaggtagaaaaaacctggcatctctgatcaaattgctaagtggaggcacatcaaaaaatgttcataagctgaagagtagcacaataattaaaggcaaagtgggccagacatggtgactcacacctataatcccagcactttgggacgccaaggtgagagaatcacttgagcccaggagttcaagaccagcctaggcaacacagtgagaccctgtctctatttaaaaaaaaaaaagcaaagtgaatgaacggaaagatagggttgcctacaaggtacattgataatcagttacaaaataaggcttaccctaatatttcaggaaacaaaagttcacaagaggccgtggtggctcacgcctgtaatcccagcactttgggaggcaggggtgggcagattacctgaggtcaggagtttgagaccagcctggccaacctggtgaaaccccacctctactgaaaatactacaattagtcaggtgtggtggcatgtgcctgtaatcccagctacttgggaggctgaagcacgagaatcacttgaacccgggagacagaggttgcagtgagccgagattgtgccactgcactccagcctgggtgacagagtgagactgtctccaaaaaaaaaaaaaaatcacaacactatccccaaaaggactgttagccttgttcaaaatgcctaggcctctatgacactcagatcataaattttagaatttgagtaaattaaaaaaggttatcaacatgattgactacaagtaccaagcttcataccattgatgtttttgttcaccaaacaagaattggtgacaattgttacgtggtagttaaaatgtatattaaaatttctgaaacttcttgatatgccatcctaaaatactcatcaatattgttcaaggcatttaagccaccaataaattacccaatagcaatgaattacacacctggacttctgtccaggttggagtacagtggcacaatcatggcacgtagcagccttgaccttccaggctgaagcaatcccactttagctttccaaatagctggaactattagcgtgcatcacaacacccagcgaattttttttttttttttaaagacagggtcccactgaattgcccaggctggtcttgaactcctaagcttaagtgatcctcccaccttggcctcccaaagtggtgggattataggcatgagccaccatgccaagccatgatttttatttatctagctcctgccaactgatttttgtgtttagtggaaacattttactacagttatctgaaaattaagtgtattcaaattattttgtgggcttctgataactttctgaagttataccctgttaaattagttgaaaaactggatactatggtcttcacagctgatctttgttggtctttttcaaatttccaaagctaatcctccactacgaggcccatggaaccatggggctcttccacaactgtgcttaatactatcactcagagagggaacttgcaacagtcagcctattaatgcctacctttcaccataaagactctgaggcagagattacatactacaggctgcaagctgaatcctgcctgtaaacaaaagtatacaatggtttttaaataaagtcgtgggctgggtgcagtggctcacgcctgtaatcccagcactttgggaggccgaggcaggcagatcatgaggtcaggagtttaagaccagcctggccaacatggtgaaaccccgtctctactaaaaatacaaaaattagctgggcatggtggtgcgtgcctgtaatcccagctactcgggaggctaaggcaggagaactgcttgaaccaggacccgggaggtggaggttgtggtgagccgagatcacaccattgcactttagcctgggcaacaagagtgaaactctgtcacaaaaaaaagaaaaaaagtaaaataaaaaaataaaaaataaataaagtcgtgggctgggcactgtggctcacacctgtaattctagtaatttgggaggccaaggtggtgagaggatcccttgaggccaggagttcaagaccagcctggttagtacagcaagactccatctctacaaaagaaaagaaaaaaaaaattaaaaattaagggggcctggtggtgtagtcctagctactccagaggctgaggcagagggaatgcttgagcccaggagtttgagattgcagtgacctatgatcacaccactgtactccagcctaggtgactgagaccttatctcaaataaagaacaaaaaacagacaaacaaaagttgtgaacactaaacaatctggagaatcacataaaaacaaagttctagcttctgttgaaaaagctgaagacgtggtaatagtggacccatcttctcacagggtaacaggagctaagaaaccttttcttctttagatataaaggaggaggcacacttcacacactctaataagcacagaaccattccctgttgtcttactcatagtatgcttcataagccatattctaaaaaaaaacccaacataatcacaaattacatacaatatttattttaagcaataagcctagacgacccaaataattctgcaagacttggactttttaaaaaagtcaaagatgatgtaaaatgaaagcaaaatgaaacacatgaatctgagaaattaggtggtagcataatcctacagcaaggaactagtcagtgcaactataaaattcagtcacttgattctacatccccagtgaaatatactctaagaacaataacaaaaattgtgatcttctttagtaatcatattgttggggtagtgctggaattgtaattctaagactgttgtgtatatattgtaggaaaaagaaaatgagcaatcatgatgctgttgagaactgggattttcagcgtgggagaaagaagagtgaaatataaaatcaaacaaaaatccttgggtcctatgattccatgtttaagtataacatgaactcatgatttttttaaatgaaaaaacacaacttatttcctaagctctagtcacagaaaaagcatagaaacaatgactaactcactcactagtaataagctccttaagcgctcagattatggtctccaaataccatttcccactaaaaggcttcttggagagacagctatttcctagccgggggcagaaaatgtacaagataagccttagacatactgtcacaccagattaaaaaaagcaatcaaagacatctcaggttgagtaaaatgaactcaggagataccatgaaaaaaaactccaattagccaacagtggacaagcaataaaaataaccacacatgatacaacatgcacgaattttattattttttttttgagacagagtctcactctgtcacctggtctggagttcagtggcatgatctcggcttactgcaacctccacctcccaggttcaagtgattctcatgcctcagcctcctgagtagctgggattacaggcgtgcaccatcacgcccagctgatttttgtatttttagtagagacagggttaggccatgttggccaggctggtgtcaaactcctggcctcaaacgatccaccggccttggcctcccaaagtgctgagattacagatgtgagccatgcacgaatattaaaaacattaagtaaaagaagccagtcactaaagataacatatgttatgattccatttatatgaaatgtccagaacaggaaattccataggcacagaaagtagattagtggctgcctaaggttgaaggtgaggcagtgtcgggagtcaaggggtatgactgctaataggtccaggtttcttttggagttgatgaaaacaacctaaatttacactgcagtgatgtttgtgcaactctatgaacatactaaaaaccactgaattgcacagttaaaatgagttttaattatacctccataaaactgtaggaaaaaaaaacccactctaatggactaaaccacaaatacgttcaaatttgtgagttattatcaaatgtttattggtcattttggagcatgctagggatctgtcaactctctctctgggtaaccaaagttatgagataaagtttctctttatagaagtattacaattaataaattaagaaatagaatattaccatttttgaaaccctaaataaattaatggatctaagcaaggatcaatagccactaacaccacaaaaagagagacaaccagaattgatgtttcctgatgaaagtttacaccaccacccataggtagtttgccaaaaacaaatctgcaaggaaaagaaccacagagaacttacagagtaaaagactagaaacttttcaaacaaaggcaatggaaagactttgtggatcctgatccaaagaaaattaggaaaatttgaacacagattgaatacttgacattaaagacttgtttaaaaaaatttagggcaattatactaccgtagctatgctttaaaaaaattaagagtctataatttataaaataatatgatgcctgggatttgctttaaaataagatggagtgaggctgggcgcgatggctcacacctgtaatcccagcactttgagaggctgaggtgggtggatcacctgagatcaggagttcaagaccagcctgaccaacatagtgaaactccatttctactaaaaacacaaaattagctgagtgtggtggcacatgtctgtaatcccagctacttgggaggctgaggcaggagaatcacttgaacccgggaggcgggggttgcagtgagccgagattgcaccattgcactccagcctgggcaatgagaacaaaactccgtctcaaaaaataaaaaataaaaaataaaaaataagtaagatggagtgaacacatgaataacaagaaagaggaacagccttgatatagtttggctctgtgtctctacacaaatctcatgtcaaattgtaatccccacatcagcagagggatgaggtgggaggtcactgggtcatgggggtggttcacccacgctgttctgatagtttgtgagttctcacgagagctgatggttttaaagtgtggcacttcctcgttctcgcagacattccctcctgccaccttgtgaagaaggtgcctgcttccccttcaccttccaccatgattgtaagtttcctgagccctcgttatgcttcctgttaagcctgtggaactgtgaatcaaacttctttcctttatatacccggtctcaggtagtattctttatagcagtgtgaaatggactaatacagtaaattggtaccacagagagtggggtactgctataaagatacttgaaaatgtggaagcaactttggaactgggtagtgggcagaggttggaacagtttggaggagggctcagaagaaaacagtaagatgtagcaaagtttggagcttcctagagacttgcactattttgaccaaaatgctgatagtgaggtgaacaatgaagtccaggctgaagtggtctcagacggagacaaagaacttattgggactaaagtaaaggtcactcatgctatgctttagcagagactggcagcattctgcccctgccctagagatctgtggaagtttgaacttgacagagatcatttagggtatttggcagaagaaatttctaagcagcaaagcattcaagacatgacctgggttattctgaaagcattcagttttatgcattcagaaagaaatcatttgaaattgggacttatgtttaaaagtgaaacaaagaataaaagtttgggaaatgtgtagcctgacaatgggatagaaaagaaaaaaacattttctggggagaaattcaagctggctgctaatcaccaagacaatagagaaaatgtcgtcagggcatgtcagagatcttggcgacagcccctctcatcacagactcagaggcttaggaggaaaaagctaaaaggggctaaggtacagcttgggccattgcttcagagggttcaagccccaagccttggcagcttccacgtggtgttgggcctgcaggtgcacagaagtcaataattgaatctctgtctagatttcagaggacatatggaaatgcctggatgcccaggcagaagtctgctgcaggggtggagccctcatggagaacctgtgctagggccatgcaaaggggaaatgtggggctggggcccccacacagagtctgcaccggggcactgcctagtggagctgtgaggagtgggccactgttctccagaccccagaagggtagatccaccaatagcttgcaccatgtacctggaaaagccacaggcactcaatgccagtccatgaaggagctgcccaaggctatgggatcccaccccttgcatcggcatgccctggatgtgagacacagagtcaaaggagattattttggagctttaaaatttagtgacagcccggctgaatttcagactttaatggggtctgtagcccctttgttttggacaatttctcccatttggaatgggaacatttgcccaatgcctgtatccccattgtatcttggaagtaactaacttgcttttgattttataggcttataggtggaagagacttgtctcagatgagactttggacttgggactcttgagttaatactggaatgggttaagactttgggggatagttgggaaggcatgattattttgcaatgtgaggacaagagatctgggaggggccaagagtgaaataatacagtttggctctgtgtccccacccaaatctcatctcaaattgtaatacccacatgtcatgggagagaccacgtgggaggtgatcagatcatgggggtggctcccctcatgctgttctcatgatagttctcacgagacctgatggttttgaagtgtggcacttccttgctgttgcacacacttcctcctgccaacttgtgaagaagatgcctgcttcccctttgcctttcaccatgattctaagtttcctgaggcctcccagccatgcttcctggtaagcctgtggaactgtgagtcaattaaacctctttcctttataattacccagtctcaggtaatattctttacagcagtgtgagaacagattaatacaagcctcatttctttctttttttttttaagatggagtttcgctcttattgctcaggctagagtgcaatggcatgatctcagctcactgcaacctccacctcctgggttcaagagattctcctgcctcagcctcccaagtagctgggattacaggcatgcgccaccgcacccgactaattttgtatttttagtagagacgggctttcaccatgttggtcaggctggtctcgaactcccgacctcaggtgatccatctgcctcagcctcccaaagtgctgggattacaggagtgagccaccacgcccagcttgcaagcctcatttctgagatggagaaagttttagtggtctgaatagaagatcataccaaccacaacattctctttagccaaaacccaatccagagcaaggccctggattttatgaagtttgtgagaggtgaggaagctgcagaagaaaaatttgaaggtagcagaggttggttcatgaagtttacagaaagaagccatccccataacataaaagtgcaaggtaaagcagtgagtgctgatgaaaaagctgcagcaagttacctagatgctaagataattgatgaaggtggctatactaaacagcagattttaggtgtagacaaaagagccttctattggaagatgatgccatctaggactttcatagctggagacaagtcaatgactggcttcaaagcttcaaaggacaggctgactcttgttagcagctaacgtacctagtgactttaagttgaggccaatactaatttacaatcacaaaaatcttagggctcttaagaattatgctaaatctactctgcctgtgctctataaatggaacaacaaagcctagatgacagaacatctgtttactgcatagtttactgaatattttaaggccactattgagaccttctgctcagaaaaatagattcctttgaaaatattactgctcatttgcaatgtacctagtcacccaagagctctgatgggaatgtacaaagagattaatgttgtttccatgcctactgacataacatgtattctgcagcccatggatcaaggagtcatttcaactttcaagtcttattatttaagaaatacatttgataaggcaatagctaccatagtgattcctctgatgggtctgggaaaaatctattgaaaaccttctggaaaggattcacgattctatatgccattaagaacagtcatggggagaggtaaaaatatcaacattaacaggagtttggaagaagttgattccaaccctcatgcatgactgaaatgttcaagacttctgtggaggaagtaactacagatgtggtagaaacagcaagaggactagaattagacatggatcctgaagatgtgactaaattgctccaatctcataataaaacttgaacagatgaggagctgcttcttatgatgagaaagtggttacttggccgggcgtggtggctcacgcctgtaatcccagcactttgggaggccaaggtgggaggatggcttgagcccaggagttcaagaccagcatgggcaacatggtgagaccctgtctcaaaataactgattagtttattaattaatttttttaaaaaataagtttctttcttttttgtttttaagagctaaggtctcactatgttgcccaggctggccttgaactcctgggcccaagcaatcctcccatctcggcctccgaagtagctaggaccacaggtgcatgccaccacacccagcagaaagcggtttcttgagatggaatctactattggtaaagatgctgtgaacattgttgaaatgacaacaagggacttagaatataacataatcttaatttataaaacagtagcacagtttgaaaggactgactccaattttgaaataagttcctctgtgggttaaatactatcaaacatcatcgcatactacagaaaaatctttgggtaagggagggtcaataaatgcagcaaacttcattgtttaagaaattgccacagctactccaaccttgagcagccgccagatgagtcagcagccatcaatactgaggcaagaccatagctgggtgcagtggttcacacccctaatcccaactactcaggaggctaaggcaggaggactgcttgaggccaagaattcaaggccagcttgagggcaacataatgagattccatcccttaaaaaaaataaaaaaataaaaaataaaaaatgagctgggcatggtggcatgtgcctgtaatcctagctacttgggagactgatgcaggaggaacgcatgcacccaggagttcgatgctgcagtgagctatgatagcaccactgcactccagcctgggcaacagtaccagaccccatctcccttaaacaaaaattattattgaggcaagaccttataccagcaaaaagattatgactcactgagggctcagatgatccttaacattttttagcaataacgtatttttaaattaaggtctgtacatttttaaaagacatgacgctactgcaaagttaacagactacagtacagtgcaaacataacttttatatgcattgggaaacaaaaactttgtgtgactcgctttgaggtggtctggaactgaacgtgaacccatagtatctccaaagtatgcctgtaatactttagccaatttaaaaatatccccaaactagtaacagtgatagagaggatttggagagcatgagcaaaagagcttacctaaagtgggaaaaaccccacaaaaaagtgccagttattccacaaggtctaaattgattttagttgatcatctttcttcccttcttttggagacaggggtcttgttctgtcacctaggctggagtgcagtggcataatcacagctcactgtagcctctacctcctgggctcaagagatcctctcacctcagtctcctgagtagctgggactacaggcacgtgccaccacacccagctaacttttgtgtttttagaagacaggatcttgccatgttgcccaggctaatctcaagttcctgggctcaaggccttggcctcccaaagtgctgggattacaggcataagccactgtaccgagcctttttcacttttagtaagggaattcctaagcacccgcagccttattcactttggcacttcaacaagttgctggtttcaagtaatctaaaggaaaatggtaatttgtcaagcctgggatgcactgtagtagaaacactaatgtaaataaaacttactaaccaatgaaactacagaggaagaagagaacaaaatattttctgacaagagaagttctagaaattcaattttgcaagtaaatttatatttaagggaatcacacacaattaaaaatgcaaattttaaaaaagatataacagttgaccttgaggtaggagaatcacttgaattcacttgaatcactccaactcgggaggtggaggttgcagtgagccgagatcgcgccactacactcccacctgggcaacagaacaagaccccgtctcaaaaaaaagtaaaaagcaaaggaggccaggcacagtggctcacgcctgtaattccaacactttgggaggccagggtaggtgatcacctgaagtcaggagtttgagatcagcctggacaacatggtgaaaccccgtctctactaaaaatataaaaattagccaggtgtggtggcacgcacctgtaatcccagctactcgggagcctgaggcaggagaattgcttgaacccaggaggcggaagttgcagtgagccaagatcatgccactgtactccagtctgggtgacagagcgagattccatctcaaaaaaagaaaaaaaaataaaagagagagaaaaaagaaaaagcagaggaaaagacaaatttgccacggttttaaaaatcaatttatgtaaaaagcacactataagtgacatctgaaggacctataacaagctgagaaataaaagtctgccgcacaacaaaggatactttctctttttttttttttttttttttttgagatggagttttgctcttgtcgcccaggctggagtgcaatggcacgatctcggctcactgcaacctccacctcccaggttcaagcaattctcctgcctcagcctcccaagtagctgggattacaggcatgcaccatgacgcccggctaattttttgtatttttagtagagaaggggtttctccatgttgatcaggctggtctcgaactcccgaccttgggtgatccacacgcctcagcctcccaaagtgctgggattacaggcttgagtcaccagacctggctaggatacattcttaataaagagttcttaagatcaagaaaaagatcaacaatctaatattaaaaatgggcaaaaaattcaaaattacaacaaggtattttatagattaccagatttggcaagatttttcaagtaatattacctagttctggtggcttcacaggagatacaagaacactcccatttccactgctttgcctagagcagtcctcttccaagtctttgttcaaatgtcaccttttcagtgtggcctccatcaccctatttaaaactgtaaccttatctccatttctcaacccccacttatctttctcttttttctccacctatcacctaatatactatttaatttacttatttatgtctattgtttattctgtctttcctcccactataataatatagtagccaacgggacaggaatgtttttctttcactgctgaatcccgaatatggaaaacaatgcttgggacagggtgggagatcaaaaactatttgtttaatgaataagagttaaactagttaaatccttttttttttttgaaacggaactttgctttgttgcccaggctagagtgcagtggtacgatgttggctcactacaatctccacctcccgggttcaagcgattctcctgcctcagcctcctgtgtggctgggattacaggcacctgccaccacacctggctaatttttgtatttccagaagcagggtttcactgtattgaccaggctggtcttgaactcctgacctcaagtgatccccctgcctcagcctcccaaagtgccaggattacaggcttgagccactgtgcccggccaaacctgttaaatcttgctggaggaaggccgggtatggcggcttacatctgtaatcctggcactttgggaggctgaggcgggcagaacgcgacgtcaggagatcgagaccatctcggctaacacagttaaacctcgtctctactaaaaatgcaaaaacaaaattagccaggcatggtggcgggcgcctgtagtcccggctactcgggaggctgaggcaggagaatggcatgaacccgggagggggagcttgcagtgagccgagatcacgccactgcactccagcctggacgacagagcaagacaccgtctcaaaaaaaaaaaaaaaaaagaaaaatcttgctggacaaaattttgacaaaatgaactaaaaatattttaaatgtatataccattcgaagtatttatcctaaggaaataatcactgatgtaagcaatgatttgtccaaaagattattcactatagctgtgaattaattgtgaaaaactggaaacagcccatagtggaatatttaatacacgaaaaatactcatgataatgttaactagggaaaagtatgcccagtgattccatttttgtctttaaaggtatatacaggccaggtgcggtggctcacgcctgtaagcctagcactttgggaggccgaggtgggcggatcatgaggtcaggagatggagaccattctggctaacacggtgaaatcccgtctctactaaaaatacaaaaaattagtggggcgtggtggcacacacctgtagtcccagctactctggaggctgaggcaggagaatcacttgaacccaggaggcggaggttgcagagagccgagattgcaccactgaactccagcctgggcgacagaacgagactctgtctcaaaaacaaaaaaaaaaaaaaatatatacacacacacacacacacacacacacacacacacacacacacacacgtttattaataaaaattaaaataaattatggttggctggacacagtggtatgtgcctgtaatcccagctactcgagaaactgagacaggagaatcgcttgaacccaggaggctgaggttgcagtgagctgagatctcaccactgcactccagactggatgacaagagcgaagactctgcctcaaataaataaataaataaattaattaattaattaattaaattatggcatatcaacttaatggaatgctagatgaggttctctttctgtcctgacatggaactatttctaagactcagtgaaaaaggcagaccctaaaaaaaatagtaaggctgcactatatggaatatagaaccaatttccaaggtgcactgctaagtgtaaaaagcatcaaatactatttcattttttaaattgtttcaaatttactggctctacttcctactgaataaaaatgttagatatttaagtattttctcttgtaaattttttttttaatttgtggccaaattcaagtaaattttcaatatatctcccaaatgactccacaaatcagtgttagagctgaattaattttactaccaaatgtatactaaatccataattatttaactgcaaataaagtgaaaattactgtccaaaccagcttcctaaggtaagtaataaaatcagtaagtatgaaatccattctggaattatgttccatagaaacaacttcaaaaacagacatataggtcaggcacggtagctcacacctgtaataccagcactatgagaggccaaggcaggtggatcactcgaggtcgagtttgagaccagcctggccaacatggtgaaaccctgtctctaccccgaaaaatacaaaaattagccgggcgtggtggcaggtgcttgtaatctcagctacttgggaggctgaggcaggagaatggcttgagcccgggaggcagaggttgcagtgagctgagaatgcgccactgcactccagcccgggtgacagagtgagactctgtctcaaaaaacaaaacaaaacaaaacaaaaacagacacacactgttaaattataaaagcttatgacaaacaaataaaggctcacagctattggtataaacactgaaaacaaatgttcagagggagatagatgattgtgctgtttcatagacacaggacagtatgtcatgaaagggcacccaaacccccaagcatccagaggtctctcattcagaagcctctttcaactcagcttctaccttacctgttgtaagacacaccaaaagcactgtcacttagaaacacatgattggtagccagggctttgggtatgtcagacctgggttcaaatcccagctttgcaattttctaggggagtaatctgacaaacctcaattctcttatctgtaaagtaaaatggagatcatcaccaactagttaatgttagtaaataaaagcacagcgtccacaaaagtaaaatgaagaattgtctaaataagaaaatttaaaatcccaaagtcaaatactccagcacagtgaaaagaacccaaaggaaatccactctaacaaacacagagctggaaagggaccctgaattccaagttttggttcttctgtcaccagcttcaagaccctgggtttaagatctgcagtaccaggggactgaaaatcccttctgcctgtgacacaacacgactaaattactaaggatgctatttactgtaacagttccaaaactttctaaaattttcatttaaacgctttgtttttatatctttaggtcctgatcagttttcactatgactgaactgccagtcaggatatatacataagactgtttccttaactaacttgtctaaggtcagattgctaaaaagtagcaaaatcagaattcaaaaccacatctatctccaaagaccaaactctatggcatgcttcttcctcaaatcttcttcctgactcacctcctgtaactagcagcttgccttagcaaagtaaatggaagtcatcaggagtgcagtcagaagtcatggaacagagtcaagttaccttagttgaggcttgaacttctaacacagtactctaaccaacttaattagacatttcagctacttaaaaggaggctgggatacaaacaaaagaaaagaaagacagaaagaaagacaaaaaggaagaaagaaaaagagcaaggtgcagtggctcatgcctgtaatcccagcactttgggaggctgaggcaggcggattacctgagctcaggagttcgagaccagcctgggcaacatggcgaaactctctctctacaaaaaatacaaaaattaaccaggcgtagtggcacacgcctgtagtcccagctacttggggggctgaggcaagagaattgcttgaatctggtaggtggaggttgcagtgagccgagatcgcaccattgcactgcagcctgggcaacaggctttctttttgcctcaaaaagaaaaagaaaaaaaaggtaggtaaattcaaaaacaaacaaacaaaaaaaacttattaattggaaacaaatccaaaaataaaacacctctgaagttacaaggaaatgggggcagttcattcacgcatattttcaggattcaaagttgttcaagatgaaatattcagtaaaatgactgctagattatctataatccatacttgcaaacaattaacacaaataactctaagttatccatagtagtgaatggggtaacagatacacatctgactttagaaataaagcatatggtctaaatagataatcgaaagtaacagatttctggtgcttaaagtatatcatctatatacatttacccctcaaattacagcttgatttgggctaatctcaaattaatttctaagtggtaagagagatctggacaaatagtctgagagaccaggatttctaaaaaatacagagtaatataataaaaactgcaacttccttgtatcaatagaaaagaacgttttaacacattctcatcaattccacaaagaataactaaactaggcacagaaaagtaacatttcaagtcctactgcacactagaaccaagttagcaccttgctgtttctattaaacgatctaggattaaaaactggttttgaataatcccatatatggataatccaaaggtaaacagacacacacaaactctcatttacaagacttcgtcaccaagcacttacaaaatacatttcataagacagaagagaaaatggagcaagaggtgaggtcacctaccactttagttctattgaaagagagaagtcattatgtgctctccccaaacagtaggtagcctccaaaaacaacacacacccctacacccccctaatctggtattgtcattcagtggggtgacctaggaaggcctttgaaatgtgttgtatcagctcagagggaattagaccgcatacgatgccacaaaacatcaaataaatgtaaaactataaagataatacatctaaaattaagatgtattaataactaggcatacaagctctctctgaatacaaagtgtgtaagagctgatttccaagatcctttgcaattaaacgttagtacatgatgaaagttcttaaggcttagcctcacttgctgctaagcctgctacctgagtttctactaggctgtgaccaacttttgaacttgccacgatagcactaaactactgttatgcatcctactgataaaactggacatgtggcgcttaatacgccaaaccagaatcatcaatgtttgttaaagaactctcccgttactattgtgatgtccactccggaagattatctgcatctggttgaggtttagacagaagagaagcagttaacagacaccgactgtatacacagcggtctgccggcacactgcaaaaaagccgatacgccttacaggctcaggaagttgactaacccagggaaaagccccatgccctcctctatgaaagggagtgtgtggttggtagaacccaaagtaaacacggaaaaattcattcaagaatttccttaaggcctaccgtgaagacgtcggaggcaagttaagacgttggggagcaggtaagagagaccagagttcagaaacagaccgataatgatctaccagctccggtggggaggtccaagctaggggagtttgtgcctcctctgtggagttggggaggaaaggtaccgggcgggctctggtcctcctccgacagccctttccagcaggcccggggctgctaagacccaggcctggcgttgagcaacagcagctctcttccacatggttgctggagagcgaccctccgagctgccccgaggccatgtggctgcagccacagggtgcccaaacccggtgcacgttcaagacgtgaaaccagagcagagaaggtgccggaggaaaatccaaagaatgggatgttggggtacaagactcacttcctttgggctttgtccttcttggccttggtccttttctttcgggcctggagcgcaagcactgcaggagagagggatggatgaagggcgaatgtggaggaaaggaggcgaccaaggtgagggtggagacccagcaggggcgccaggcccggctgcggggcctgcctcgggggcggctgcgggctccggcgaggcggccggccgtggggctggcggcccacggggcgcagagcagcgcccgggcgggatgcgccggaggggtctcaggccgggtcagggggcgggcgggtgggggtctgcgtcgcccgccaagggccgggccctggagtggccccaaggcgcgagccggcctggcggggaacaaggggcggctacggccggcgccagaggacgcccggactgaggggcgcggacccgcagcccagaggcagggggtgtggggcggcgccacctcagtggaggggcgccgcacgtccgggaaccgaaccgcggcagttaagcgaagctcccggcgctgacccgggcctcgccccggcgaccattgcccctcgtggcggaggccgctccaccgctcacctttccgctccatggtgagaccggtaatcgccaggcgcctgcgcactcgagtggcggcgactcccgctcccgccgcggcccaaaaccgagcccgctcacactccgccctcagtcccgccccacccccgccccacgatgccgcgcgcttgcgcgttgggcgcggagcctaccacctgctcccgaggagggggcggcaaggagagggagggggcgcagcggggaggaacgccggggtgaacgttgaaggagtgttagagatccaagcttggaaacctggcaaggttagttttgttctatttgtttagaaaaggcgcagagagcggcagggctctctgcatgctgctgagtcagagcttcggaggcaactgggatctgcctcagtttcctggcctgtaaaatggattaatcaggcatgtcccagtttctccttccctgagctattgtgagcccagttgagatactatttaaagaaaatggaaaaaaattacatgtgagaaagaaaagggagtgggagcaacacaaaaagactggaaggaaagaacctgtgaccctattatcacttgaaaagtaaaaacttcaaaagtgaattttctcttgaaatttcaagtttaagtgaaagctgtaaaggaaagaaggggaaatgagaataaaaacgtttaatgttttcttattctaccaccttcaatacatgataaagctgtcttgtttataagttttttttgtttttattttctaagtgcattatctcatttgatgtttatggcaacttaaaggcaaaatagttattacttccattacacaaagacactaaacttaagagggcctgcctatatgttcagaatcttggtgtacgacccagttatttaatcatgaagcccttattgtatagcaggctcagcaaagtttttctttgggccgtacagtaaatatttaggctttgtggaccataagatctctttctcagctactcaactctgccattggagctcaaaagcagtcatagaaaatatgggctgtgttcctataaagatttatgtatggacactgaaatttgaatttcatataattttcacgtcataaaatgttcttctattgatttaaacatggtctttgttaggttttgaagggaaggtgagggttaaagaaagacagagagagcagtcttgctctgctgcctaggccggagtacagtggcatgatctcggctcactgcagcctggacatccagggctcaagtgatcctcccacctcagcctcccaaggtgctggaattacaggtgtgagccactgagccaggcccttttgatcttttttcaaccgtttcaacggttattcttatttcagatcttagtttaccaacccatgttgtaaagtaccgcagctggacagagtggaagctctgaagacctttgctctgaacaagtaattgagaagggaagatgagagggcaatagtacagcacaagtcaagcatgggggctttggcagaacttattgagcaaagtaagtaattaagcccatccagagaaggcagtttttgagctgggtattaggaaatatgtaagatttctataggtggagaaggagatgtcaggcattcctgaatgagaaaatacattgagcaaaaaggcacagacgtggacacctgtaggtgggggctaggattggggctggtaacaactgaagggatgaaatggaaggtgaggctggaaaggcaggttagccaaatttgaaatttagataattgatatatgttgcatggaacctgaatgatagcatgtctgagtatattgcaaaagaagacagtacctgttggccaaggaaggatgcagcccagtctattccctgctgtaaagttgaaaacaaaaggaaggttaggacagacagggaagccctagactctgagggttgtgtgagttcaggataaccgcgtgtggtttagaaaagacagggagagagctgatagctaggaaaaatcccagaattgggaaagtactgcccaccccaaagtaaactgtttgagtgtagagaccctgcttaggttttccttgatgtaaactcagtgcctacacagtgttaggcacttagtaggtgctcatatatttgtctaataaaagaataaatgggccaggcacagtggcttatgcctgtaatcccagcactttgggaggccgaggcgggcagatcacaaggttaagagatcgagaccatcctggccaacatggtgaaacctcatctctactaaaaatacaaaagtagccgggcatggtggcacatgcctgtaatcccagctacttgggaggctgaggcaggagaatcgcttgaacccgggaggcggaggttgcagtgagccgagattgcaccactgcactccagcctgggcaacaagagcaaaactccgtctcaaaagaaaaaaaaaagaataaatgatctgcagtttatgagaaatgtcaggatgaaagagagagaaaacactgagagggacaatattagagctgtattaaatctgaattggttattgcagacccatcaaaaaggaaatatgttcagcttggcatgatacagtcgtacctatcctgactctgagtaggctattgcttctctaagagcttactaaccatctgtttaataactcgttttcagaatttttccagagtcaatgtgaagttcactggactgagttcccagaattgaccatttctcttttttttccatctgtttttctctattcctccatcatgctttggctctccactttttctaagacctctataactgttcatgtaagcacgtttgttcatttcccctattctacaaccatcccctttttgtgcattttgcttgaaatgtaactttaaaaatagtttcttctcccaagtttgcagagcttggcctattctggacttttaactttccagaatttttttttttctttgacagggtctcactctgtcacccaggcaggagcgcagtggcgaaatctttcctcactgcaacccgggctcaagcaattttttcacctcagcctccccagtagctggaactactacaggcacatgccaccatatccacttgatttttgtgttttttatagagatggggttttgccacattgcccaggctggtttggaactcctgggctcaaacaatctgccccccttaggctccccagaaactattcttaaaagtgttagcaaaaaaaaaaaaaaaaagtgtaggccaagcacagtggctcatgcctgtaatcccaacacttagggaggcagaggcaggaggataccttgagcctaagagttagagacctgcctgggcaatacagcaagacccttttctgcacaaaaaggaaaaaagaaagacacaaaaaaagtggtagctattcattcttacatgcataccccttctccatcagctatttttttcctgcaagtccctttaaaagtagaggtattcggaaaccataacccatcatatttttggctgctcatggtagtctcagaatttaatttctgaaaagatcctatcccttttgagctaacttacttattaagactccctggaatcttctctaatacttctttgacattttagaaatctgaacgtctaaagttgagttcacacgtttcttcatacccaacattgtctgccttgattatcacaaattattatgctttgtctaaagttttgatctgacttaaatccaaagcaacacatccctttatggcctcccctacgtcttgcgagatgaaatggacaacaggagaaagtgaaaatacatgagatgatttattttgaatgagttaagatttccaatagctgtctgcataattggaaaaccccaaaaaaactttctcttaccttttggatacatggttttgtgaattatattgggaaaatctacatattataggcctgggtatcaggaaacacatggcacatttaaaggctaattgaagagaatttaatgaaggaataaaggtgttaaggaaaacaaacaagggatagttagacatccagggactagcaacagctggagtttttaccatctctaggcctgaagggagaagaggatggaggtgttatcagaacccagggagaggtttattattaacaatttgccaggggccggacgcggtggctcacgcctgtaatcccagcactttgggaggccaagacgggtggatcacctgaggtcaggagttcaagaccagcctgttcaacatgatgaaaccccgtctctactaaaaatacaaaaaaaaaaaaaaaaaaattagctgggcatggtggcgggcgcttgtaatcccagctacttgggagactgaggcaggagaatcgcttgaacctgggaggcagaggttgcagtaagccgagattgcgccactgcactccagcctgggcaacaaaaacaaaactctgtctcaaaaaaaaaaaaaaaaaagttttccaggggctgccataacaaagtaccacaaactgggtagcttaaacaatagaaaattcttgtctcacaggcttagaagtctgaaatcaaggtattggcagggttggttccttctgaggtctgtgagagagaatgtgtttcaggcccttctccttgccttctgggtaaccatcatctccctcgccacatgctcttccctgtgcatctgtctctcattgtgttgggatttcccctttttatacggacaccagtcatactgcattgggcttcatcctaaaaacctcattttaatttgattacctctggaaagaccctgtttccaagtaaggacacattctgaggtactggagattaggactccaacatatcttttgttgggtggggggcaaaattcaacccataacagagctgtagtaagagaggcccgcctggcagcagctgtgccctttaatgagccctgcagggagagggcagggaaataaagacccacatcttctcaaacgagtgcctcaccattgacaaaacccagctggaagttaaatggcaaggaagcctgggtgatgcagtccatacatgccagcctcccagggcataaagcagggtggagaaaggtggagagtggatctggagggccaaacagagaatatccagcatagcctgtctgggcagtcagacacccaaagcagctggcattttccaagcaggtaaatctgcctcttgggcaccctgacccctggagaaccaatgccacctggagatgaccccatttctggcttcattctataaaagcttaagtttcacaaagaaattgtgctggggtgaaagatccgggggcgtaggtggagaagatgaaagaataaaggccttggcttgttggggtgggaataaaggcagtagctaggaggggaaggggattctctaagaatgaggaggttagagattggtgattcctgagcaggtagggcccttgctctgctccctggaagtgttctgggtgggagcaaggtgttgcaaactgaccttagctgatcatgcccaactcttagctttttttggttgggagtgatgcctgccagagaagcttgacatggtgagggtttgcctccctggcaggcctactcccaggacataaagaaaagtttcagactaaaatctgccacatgtaggtttgttgcacacccattagcaggcaggcacaaaacaggtcctataacctgtcctgtaagttctttgaggtcccagctctctgtccttttaggtgctctggccacagcatgaatgaaaggtttactcacggcagggacaacaatatcccagagtcaggactctcaccctcacagtcgggatcaggcaactagagatggagtctcccttatgtttgttatgctgttccaaacctgattcacatcacaggagttatcagaaatgggttttcactggtgaaaagagttgcttgttaatttgtgtaatggattttagaaaagggctgtcattgtcaaaatttatggcagtcaatgactctgaattactttgttgtagtcactttctgagtagaatatttactaaccactcttggaatggaaattgctgattaaaacacaagctgcacctaggtgtgtaaataactggtgcctacaaatgtcatcctgtctttcccaaaagatttaatatgcccaagtattttttttttttttttgagatggagtcttgctctgtcacctaggctggagtgcagtggcacaatcttgactcactgcaagctccgcctcccgggttcatgccattctcctgcctcagcctcccgagtagctgggactacaggcgcccaccacgacgcccggctaattttttgtatttttagtaaagacggggtttcactgtgttagccaggatctcctgacctcgtgatccacccaccttggcctcccaaagtgctgggattacaggcatgagccacggtgcccggcccccaggtattttttttaagaagtagatttatttctttaaaatgccaatttaaaaaaaaagcaatctgggagtccaagacgaggggaatgtaagaaagtcttaccgcacatcccctctatgtgagttgccaaaacagaaacatgctggatcctatctaaggttctagaagtcccagaagagctttcttaaatatccttacctagaatatgctttccttgccttgattccaaggatagatgccaaagtattttaaggtaaattataaatataagattgggggcccctaagaggctcccaagccagacaaagatgctctgctatacttagcatgttccaggggtcatgcagacttagacaataaaaataatgaacttaagatcaaaagtctgactaggcacggtggctcatgcctgtaatcccagcactttggaaggccaaggcgggcagatcacctgaggtcaggagtttgagaccagcctggccaacatggcaaaaccctctctctactaaaaatacaaaaattagccgggcatggtggctcatgtctgtaatccaagctacttgggaggctaaggcaggagaactgcttgaacctgggagacagaggtttcagggagcagatgtcataccactgaactccagcctgggtgacagagcgagaatccatcaagatcaaaagtctttactgtttcctgagcagtgtgtaaacctcccagactcttacgtgacccttgagagacaagctctataaggactgtgatttaacttctccatcatggcaggcttgggggcacactgaagtcaatttaggaaatacatagaaatggacaacatggcttacacatttgagatctgatttctactggctatgcaatgttaaatccatttttttgtttccttctttcaaatactttccaccatacttaccctcatgacagacatttacacttcagcccttaggctgtgagaagcaaagaaggaaaaaaataggccttgctctgtaggatttaatagctaactcttatataacaattactggctgggtgcgatggctcatgcctgtaatcccaacactttgggaggccgaggtgagcagatcacgaggtcaggagttggagaccagcctgactaacatggtgaaaccccgtctctactaaaaaaacaaaaattagccaggcatggtggcgcccacctgtaatcccagctatacaggaggctgaggcaggagaatcgctagaacccgggaggcggaggttgcagtgagctgaggtcatgccactgcactcgaacctgggtgacagagcgagactccgtctcaaacaaacaacaacaacaaaattactatttactagtcactgttgtcccacaaccctgaaaccctacaagataggtactattcttttaatctctgacaggaaaaaactaaggcacaaccaagatcatgcaaggtaataagaggcaaggttttgaatctgggaagtcagactctggaattcatactctcagccacacactatattacctacccagtgtagtgggggatggatagataagtaagtaattaaatacaatgtacaatggtagatgcagaagctaccctggaagcacaagaaaagaggccccgtcagctcaggatttatagagaggcaaggaaagaggcatctcttggatgagtgacacctggacagagttggaaagcatgagtaggtatcagctgcacacaaaagggaggaaagaaaactccagtcagagaaaacagcatggtatcacagaggtataaaatgtaagggggccaggcacagtggctcatgcctgtaatcccagcactttgggaggctgagacgggaggattgcttgaggtcaggagttcaggaccagcctgcgcaacaaactgagaccttgtctctacaaaaaaaaaaaaaaaaaaaaaaaaatttaaatagctgtgcatactggcaggcacctgggggcccagctacttgggaggctgaggcaggaggattgcttgagcccaggaggttgttgcagtgacccataattatgccactgtacttcagcttgggcgatagagtgagaccctctctcaaaacaaacaaaacatgtatatatatatacacacacacacacacacatataatgcaagcggggagtggtgagagatagcttgcccacaaatatttatgggcccccttcttttttaggcaggtactgtgtttggtgctggggtaacaaatagcagggatagcacatctaaggaacttgaactttcaagcattatgctcccttacccactaaaataatcttaaaaactagccctaggcaaaacactcaacaaaccaggaatggaaaggaattttctcaacctgatcaaggtcatctatgaaacacccacagctaacatcatatttaatgatgaaaggctgaatgccctccccctaagatcaggaaccagaggaggatgtccactctcgccattcctgttcagtactgtgctggaggttctagccagaaacaataggcaagaaaattaaataaaaggcatacagattggaagggaatttgaaattttaaaataaagctgttatatcacagttttgaatgtcatccaatggaatttaaatatatatagcaatttgttatgtaccatcatccatttatatagagagatatataaagcaaaagcactcttggtactataataaattctacattactcgtttttctccttgaacttgtctttctattccattttgttctcacagaagtttatcctctgctaattttatgcttgaaagtcttttatcgatcatcctttcatacttctctgccacacaaatgtgcatttatgtggaaatttaatttgtaaaaacatttcctcggaccataatccttcgaaaagttccttacctattattacaagtattattattgcatgattaatcaaagtaacatatagcatcatttttcaataaatgaaattttattgcaaatgcatttcagtgtgatggtatgtgatttttctcaatgagtcctgcatcattctattccttttttttttttattaagaaaacttacataaaacaagtagatgggaatgaaaaggggtttgctatagcaatagcattcagttcttttggaactgtttccaaataatgtgccaaaaatcacacaacaatcatagtccaaactcattttaatgacccatcagctgacaattccaggaggtccttattcaattttgttggaaacaaataattggaagctacctaacttacaaaaagatgtgttacttggtcattaaagttccttacttttttaatccagacaccagtatttcagtatattccttcgagtggacccctgggagatttatacacccactggcaatgcacctgagattcactgggggagggagagaggcgtttgtttttggttgtttgtttgcttgctacttttgtctgctccaccacaccttggaatgatagctccataaaggctgagatgtttgatttttgttcactgctgtatctccaggacatagaaagctgttggataccctacctacttgatgcttgatgaatgtatgtggaatgttatgaaagaatgtaaaaactacctgtttctggctgtatgcttttgagaggtgacagcgtgctggcagtcctcacagccctcgcttgctctcggcgcttcctctgcctgggctcccattttggcggcacttgagaagc

SEQ ID NO: 359 - DNA, 73012 bp, Homo sapiens
atgaaggaatcttaggttcactttctttactttgcctggagtccatggcttaagtctcagaggcacagttttcctgtttctcaactactttaattttagcccactctcattggtaatagcctttagtgattatctttctttctaatgagccaggaaatgaactaatattatgtgtgttgtattttatccaagaactaactgtattttagcaggaggatccttgagtatacctagtcaaccatatggcaggaagcagaaatcatctacttcgtagttgattttggtaatttgcatttttcatataaattattcattttctgttttgtgatatattggcataaagttgtttatagtgtcttattattttaaaatctatgtttggttatttatctgtactttcattcctaaattttttatgtcttctgtttttttccaaatcggtttcaccaagttatgtgtactttatttatttaaagagaccaacttttgtttaaattgatcctctcaaaaaaaaaaaaattgatactctcttctatagtataggtttatactccaggggtcaaccaacattttcggtaaagggccagaaattttaaaattgaaaaatgcaggaatcaatatgaaacacttaattgataggctcaatagcagaatggaagctactgcagaaagaatgaataaatctgaagataaaatgatagaaattacacagtctgaacaacagaagaaaacaggcagaacaaagatgaacagaacctcagggacttacggaactacaataaatctaacatttgtgtcatcagagtctcaaaagaaagaagaaagaaggaagactgaaaaagttcttgaaaaaaatgacagctgaaaactccccaaaattggcaaaagacataaacatatagatggtgagaagacctcaaatataataaaccccccaaatctacaagatacatcatggttaaacaactaaaaactaaacacaaaggaaaaaaagaaaaagaaaaaagacaaatgacacctatctatagggaccaaaacaatttaaaaaactggatttctcatggggaaccatgaaattttctttccttttttttttttttgacaaggagtctcgttctgttgctcagactggagtacagtggtgcgatctcagctcactgtaatctccgcctacgggttcaagtgattctcctgcctcagcttcccaaatggctgggattacagatgtgcaccaccatgccggctaatttttgtatttttagtagaggcggggtttcgccatgttagccaggctggtctcaaactcctgacctcaagtgatctgcccgccttggcttcccaaagtgctgggcttacaggcgtgagccacccctcttggctggaagtggcagaacaattttcaagtgctgaaagaaaagaactataaacctacaagtctatgtctaatgtaaatattcttcagatatcaagggaaaatcaagacattttcagatgaaagaaaactgagagaatttgttgccaatggaactacaataataataataaggctaaaggagtgctctaaacagaaaggaaatgataaatgaaggagttttggaatatcagacatcaaaagtctaacaaaaaatacaaccaaaaactctacatataaatctgagagcttagatgaaatggactaattcatctaaaaatacaaactgtcacaactcaatatgaaatagataaattaaacagccatataactattgtaaaagtggaaattacaataaaaagaactccctcccccaaaatctccaggcccagatgatttcattggaaagttctatcaaatgttttaaaaagcgctgacaccaattctatacaatccgctttagaaaacagaagagaaaggaatactttccagttcattttgaagctagtattaccctgataccaccaaccagtatgtcgcattaaaacagatgcaaaaatccttaacaaaatattagccaaaagaattaagctatatatacaaagatacaccacgaccaagtggagtttatctcagggatgtaacaatggctcaacattcaaaaatcaatcaatgtatctaccacatgaatgggctaaagaagaaaaatggcattatgtaaattaaggcagaaaaagcatttgacaaaattcaacataaaattcataataaaaacttgcagaaaaaaaggaataaaagataacttccttaactttagcaagagcatctactttaaaaacctacagctaacattatacttcatggtgaaacactgaatcctttctgcctaagaccagaaacaagccaaggatctctactctcactgcttttatttctgctggaatttctacccactgcattaagggactgaaaggaaaaaaaaaaggaatataggtcagaaatgaagagataaaactattcattatttgcagatgacatgactatctatataaaaaaaaaatcccaaggaatcaatcaaaatcccctaaaatgagtaagtgggctcaataaggtctcagtatacaaaatagaaaaattcactttatttctatgtacttagaatagacatgtgaacaggaaattcaaaatacaatgccatttacaatctctctcaaaaattaaattgcttaggtataaatctaacaaaacatgtacagaccttgtatgctgaaaaccacacaatactgatgaaggaaaacaaaatttaactgaaatgaagtgaagtgatcctgtgatcatgatcgggaaggcttaacatggtaaagatgtcaaatctccccaaattgatgtataggtataacatagttcctgtcaaaatcccagtaagatatttgaatagatacagacaagattattccaaagtttatacgggaagacaaaggaactaagtggctaaaacaattttgaaaaagaaagtggaataaaccagcctatttgatttcaagacttactacagtaatcaagattttggtgttggtggaggtatagacacatagtctaatggaaaagaatagaaaacccagatatagacccacacgaatgtgcccaactgatttctcattaactcatttttgctcaactgatttttgacagaggtgcaaaaacaattcaatggacaaaaaagagccttttcgacaaatatcatgttggagtaattgaatatccataggcaacaacaaaaaaaatgaacccagacctaagtctcacattttatacaaaattaactgaaaatggaatatagacttaaaagtaaaacgtaaactataatacttttagaaaacaacataaaagagaaaatttgggggatctaaggagagaggcaaagttcttgataccagaagcatgatccataaaaagaaaaatggatagagtggacttcatcaaaattaaacacttctgctctgtgaaaggcccagaaaagagaaatgaaaagacatgctactgactgggaggaaatatttgcaaatcacacatccaacaaaggactagtatctagaaaaaaatacacacacacacacacagaggcacacacacacattatttaaaagccctcaaaactcaacagaaaaaaaatccaattagaaaagacatgaagaaacatgtcactaaagaagagatacaggtggcaaataagcatatgaaacaaagatgctcaacatcattgccattagcgaagggaaaatggtaaatcaaaactgcaatgagctgtcactatacacttatcagaatgactaaaataaaaaagagacaccaccaaatgctgaaaaggacatgaagcaactagatcactcatacaccactggtgggtatataaaatagtacagctacttggtataagtttggcaatttcttaaaaactaaacattcaactactatatgacccaactactatataactgctgggcatttgacccagaaaactagattatgttcacacaaaaacttgtacacaaatgtttatagcaactttatttatagtagccaaaaactggcccaatgtctctcagcaggtgaacagttaaacaaactgtggtacatctatactatgggattctattcacactaaaaagtacctgtcaatagacttgatacacataataagctggattaacctccagaaaatcatgctaaatgaaaaaaagccaatcccaaaaggttacatattattatgattccagttatacagctttattgaaatgaaaaaaaaaaaaactataaaaatggagaacagattatggttgccaagggttaagaagggagtagggatgggagtgaagtgggtatggtcatcaaaagcaagatgagggatccctgtgctagaaaaagttctgtgtggaaacgttctctatcttagctataccagtgtcagtatcctgggtatgatattgtatgacagttttgaaagatgttcactgtgtgggaaacaaagtgaaaggtacacgaaagaggtctctgtattatttcttacaacagcatgtgaatctagtttctcaaaagtttagttaaaaatactagcattaaacatattttatactttataaagaatgggctctatttcaaatgtccataccattccaaaggaaagtattggtcacatactccattctagatttaaagaaaatttaaaacaacatagaaaatttctaaatgactaagaaaaatgtttgaccacagatcaggaaaagacataaggacaatagggtagccctaattttgaacaaaaaatgtttgtttattgcctccaagatagaacatgaatttcttgaacaagaaatgtttattgcctccaagatagaactaacgtgaatgatatataactaaggttatcttactattagcaaattttggtatatacccactgcaaaatagtacttaaatgttaaaactatgataacctttatgaggctgaacattaaatctggccctgggaagaggttggatgtggcctgaggcacattgaaaatgcctcgaaatgaactcaaaacgaccacagtacctaggtttgagataagaatgaaataaaatatattccccattaaaatcttgcttatttttagaatcattactgacagaaggatcagctttgatctgagagcttttcaccgtcaagtttttagctatacaagttattaaaaaagcaaaagcttgcatcttacttggattaaaaacctaatttctagaaaacaggttctcttctttctggtctgagtttaacatttcagatctcccattaaacaactgatcaaaaaactttcagagggcattaaaaagtgaaactaggtatcagaaaaatcttagtcgaggctaaataactgcatttataagctttctaccaatgctattaggtgttggagttagtaactactgcctaacgatacttacagtaaacacttaaaaatttgtactttgggttggccaaagtgggaattaatgccctttcaagtttatttaaagattcaattcagttctagaaaactccctcgtcaacaagtagaggtgttgtgcgtgtaacgactggacaggaaatctggttttgccttccaccacttacattttaagcataaatgccatcactacacaaaacctacgggaatcccactctaagcaattaagtgaccaacctcttaaaaacttgccagaagctacagtgtctacaaaaacctatttagtgtgttatttagctctatttctgcatttaaaattaggattatttggagaaaaatattacataatattcatgttaaccaaatgattacaaaaacaaagaattaaaattggtgtattgatatggtatttgaataatgagaaaatgggccaataggaagattttcttctttattcctatttgatttaaaagaaaaagatttgccaagggatgggtagggttaaattaaaaacattttaagaaacatttctttatatggagcatacttactgtttttgctttgagtgcattctgatgaaatatagattccaaattccccttggatctcacccttctgtctagtgctttgccctctatttggggcagtaattctatacatatcctgtaaatgtctgtcctgatgatcaggatgcccaagctctgaatccaactgctgccaccaagagaacggctcctttttggagccattacacacagatcatcactcaaatcagtagtttctctttagaaaactagcaattttctggtagtctgtcaattaagaaaagaaaatgaaattcagttacttagtaaggaaaactggataaacaggaggctggtccaaacggagatttatatttagacattccctttcttccttgcctcattcctttcacacagctatttcccttcttttaacacaccaagttctttttatatgccaaataacaaaacataaactccctgagggcaggaagcttattcttttggttcactcttagaacactatgcccaggcatgtagtagcctggcaaaaagccggccccaaataagtgccaaattaagtatttattaagcaactactacgggagggaaggaagaagggaaggaaggaaggaaactgtgttaagtcctggggccccagaagcttagtatatgtattttttattttggttggaaaaaaatgacttgcttaccatctagagccaatgcttctaaatttttccatcaaagaatctttaatgaaagtgaggaaaattctgaggcttccacttcacgtggtttgaactgtacatctcagtgtttgtttcacaattatgctagactgtcaactcacttctctttctagaatgtcctctgcagtgcaggtagaccagaaaccacacttcccacaaactccttctgtctctggttctaagttgagagttgaccatgagaaaaggagagaccatctttcctcagaggccactgcagacagaagtgtaggcgggcagaggacatgagtttcacagcagtttcaaaatctcttgcaaggcactggctttggagctattaacagctgacagctggggacagctccctgagacacactgtcagtgctgcacgccaacagcacagccttctggatgttctcaagagtcacagcagtgcctgggccagctcctgagatccacccactttggggccgcagacaccttcctcacccacccttttgatgtctaattccctatgttaaaacactttacacttataatccatcaagtggtttctgtttttctaactgaattgttaaaatatgcaaaattcacattaaagaagtttcctacctatcttgtgacctcagtgaatgagatgctgctttatccaatctactgactttggaaaatccagctgaaatgaggaaagataatcgtgcatgtctggcaaccaggtaatttctttcctatctttcatgtcacagtattttgaggacacaaattcctaaatactcagaaaaaaatggttttatcttaattgatttataaattatgttagggtagttgttaaacagaattttgtcaaagaagcagtacactgtaacactttcaggctcccattggtttaaaatttgataagtgtatttctttgctgacaagtcaaactgttcaaatgttatggaggactaaaaaggcctgggattcacaggctcattttttgttttaactgaatcatgaaaatacacaacttttttttttccaggaaagacagatgttatttaccaccaatgaatttttatcatatttaaatgaacttgaaaatgtcattcaactcaaatccctcaatcaacttacttcagcccattctgaaacttcatattgcagcaaaccagccatgtgaaagaaataaattcaattttgactttcaaaaaaaataaatgctgcataagttacccttgtggaccttagctattaaggtggacaatgactttattttctttacgtaagttttatattttattatgacattcattttttctacatgaagacacaaataaaaattataccaactacataaactattttgtactttccttgctaaaccacagatgtatttcatggaaagaggggcctttaaaggcacttatttatcattgtaggtgtgtctaaacaattgatattcaaaaacacaactttttgtgtacaaaattttacaatttttaacaaaagcagtgaagacactaaataacccagtggcgacctcttcaaagtgcagtgtccttggtcaccaatgcagatgctactggggcagccagcgggctcagagggtccaactccagacactgcatccatggctgtcctagactgagttgcacttgtaaaagagatggtcccacacctactaaaaaaacaagctactctagtatcaatatgacatcactcttttaccatcaatcatattgcaaaaccatagtatttaacgaccaataaacagccaaatacctaatgccacattgtcgttcaatttacctggctggttaatatcagtctgtgtttgagtatttcttttgagcacacaaaaacaaatgtatagtcacttgatgaggaaattcttcactttgactcaaatggattcaccatgctgtcagttatgaaaacaactctaattttaatctccacagggcaaccttcacttttcacagcagttctaaaactgacctacagaaaagttcaagattttttaaaaaatttggctaccatactatgtttcttatttaattttctctaatcaatactactcttacgttccaaatatttcatgggaaatttttccctcaaacttaatatgtttcttaaacaaattgaagccactaaagttcctgtttaaaccactgataactgccccagttaaaataataataatttaaaatgattacacttcaaataaaggtactaaaatcacgccccccaaatttgtaagcgcttttgttgttattgggtactcactgtgaatagaagtaaatgtacttgacctgtatgagaataaacattttatcaagtacagcaaaaaaaacggaactgattgtgaaagccatggggatgggactttaaaacagcggtaagacgctggtttatcaccagaaacctcatgtgcctctgtgcacttgaagtaaagaccacatttgagcaggcctggtgggctggcacaggcctcagaacaggtgctgtttgtgtgaattctcctccctgcattgtccattctgttctagggcagtctgattctggcaacaggagtctctaagttccaatcactcactcacaaaagagttttctgtaatcccttttgtggaaaaaaatggagtttttctgatatgcaaagcaacttctaccagtctgacaaagtaggtaaaatcgatgacaccctaaaataaaaacctggagtgaactggtgctccagaaagatgctgaatggccacagtgcatgtggtgatgtctccatgctgaggtttcaggcagcacagcactaagtatcaggtgacctgtggtcccaccagagcatagtcctcatgaaataggcctaaccagataccttttaactcatctttattttggttgcaaagatgtggtttacttagctacttactatttgttcccatttgaagtctcagagcttgccaagttaaacaccgccttcagtaccgagctgctatacaagaacattataaaatacaaagtataaactaagataatcctctttacagaattcagattagtgcattaaaacaacattgatttaaaaagggaagtgagataactggcaaacctccaattgcttttttaatgaaggatgacacaaaatggcacgcaaggtaaacactaaattttgtcaggtgctcaaaaacagttaattgtgggaaagttactttccaaaagtaattttgacctaaaaatattaaccattattctataagacataagggaaggtaaataatggcccacaaaaccagatgatatggttaagataactagtttagtggaataacaaactggggtcttaagaatccaaacgcaataggtattggtattggttgttcatactcttcttccaaattatgttaaacatttttagtaactacactttcccccgtaaacatcagacttaaatagaccatatgtaaaaacaacctatccttagtaattttactaggcaatctacagcaaaagcttaatatatacacagaaagagtatcaaataaactagaaaagtattcaccgacttcagggtaaaaaagatcttaaaagaaaaccaacaaaaaaatgaaagacactttgtgctgttgtgaaccagaaaaatacaacccatgtatagaccttaattattttacattattgagaatattttccctgctgaagcaaatcaaaattaaatttgagaattttaattgaagtaacacacatctaggtgtgtcacagtgacagggagatgcaaacagaatacacacacctttaaatttacgaattcccaaaactaagtcaagcagggtaaataaattataaatgaaaggcatatgcaatgtgggcaaaaacttaacaactattaaattgaagaccaagggagttatgtcagcagtgacatttagaaaatctttcagtattagaaaatatcagatttaatccaaaggaaccaccccaacccccccaataaaaataacaaagtatgggaaccatcctttatacaatagctttaaaataataattaaaaaaacatgattacaggaatcttcctacataatttagacaatgtagtgcgacagtgtgctcctttataacttcagtggttcaatccccatatgatgagactgataatcgcaactccaatgacaaggataagaatgatgatgcacagggtttttctggatttgcgctgcagacgcaaaaaacaaaacaaaacaaaaaaacatgtttacagatttagtggagtacctctacagcaactaaaaataatttggttcatttctagagtaaaatcagtagtagtatattgccctcaaatttttgactgtgtttttttgttcctcaaaaatctctttaatacatatggcactattctttcaaaaaaattcttgaactaatgctacaattaagggagcaatttttcaactttcattggtaatttttctaagggtgtggctgaccttaagaaagaagacaccactaaataagttactgacttaaacaagagactgaggttacctatgaataaaaataaagaacagcttacgagcttaaacattctttaccttttattaaagtttttcttaaaaatgagttctctgaagatatcagtaagtacaaattggcaacttttcttcacatatatttcttttcttttttttttgagatggagtcttgctctgtcacccaggctggagtgcagtggcacaatcttggctcactgcaatctctacctaccaggttcaagagattctcctgcctcagcctcccaagtagctgggattacaggcgcgtgccaccacacccagctaattttttttttgtatttttagtagagacggagtttcaccatgttggccaggatggtcccattctcctcacctcatgatctgcccacttcggcctcccacagtgctgggattacaggcgtgagccaccacgcccagcccctcacacatatttcttgtttccaaaatacaatgattttggaatgagtttccaaaatcattctcattctttaatattaatgggaaactacattcaaaatctcaacaaacaaaaccacagagcaaacaaaatcataatgctgtcattgaaaaccgaatggttaagaattttgttccgttcttcattcctggttcagttgtagatttctttaatggcgtttgtacctcacatcaacatgcaggaatcctttttcttacaaagtagaaaaatttgtaaatttactttgtgtcaagtagaagtaccaaaatatttataaaaagatacatttctgagtctgaaattacactgaaaaccataaatagtttgaatattccacatattcatctaatttttccagtgaatactccttacgtatcaaacacaatttctctaaaatttcaataccatgcataaatatttttcccagactccagttggttaccacaaacacacatgtaatgtacctgtgagtcatcacgggtatcccacaatggtgtgtttgttgcctggggtactccccctagcgtggggtaatgagaccctggggcaatgtggtgataagtgaacttgaatttctcaccttccttattcttagggttcacccaaacatatcaaggcttccaaacagaactattggaaagctgcctcttttctcagcacttgtgctgcatggccatctcgtcccgcttcgggagctgggggaattaagcctaggggcagcttccagtcctggggtgtagcttgggacatgtgctttttcctgtaggcttggccttccacaaggaagaggaagagtaaaacttggcagaatatccacatttcccccaaatccaaaagcaaaataaaataccatgtgaacctagtcactgatggatcctgttaagtttcagcagttatatgctaacagctccagaagacttctggcatttgcaggggtgtgtgtgtgtgtgtgtgtgtgtgtgtgtgtgtgtgtgttttcaattattcgtgagggatacctaaagtccatgacacagtgatatagtgatattaatttcactgagctgcatatctgaatgacatggacaaagataataaacaggagtgactgtcagtgaatacaactggttataactcagcaatctccatagcttcattattatttacttatcactgaatatgcagtaatttgtccagtaaaagatggactgtgaaataaaggcaacttctaaggttagtgagaaaaacaaaaagcaattgaaaatgtctgagaaggtgacaatatcttagatattttataagaagttaacagcggctgggcatggtggctcccatctgtaatctcagcactttgggagactgagatgggtggatcgcttgagcccaggagttccagaccagcctgggcaacacagcaaaactctatctctacaaaaaatacaaaaattagccaggcgtgggggtacacactattcgggaggctgaggcaagagaatgtcttcagccaggaggcagaggttgcagtgaggcaagatgacaccactgcactccagcctgggcatcggagccagactctgtgtcaaaaaaaaagttaataaggtcaagaaaatgataattatgaatgatagcaacaaaggaatggagttttaaaaaggaaatcaaatgctacatggtatttaggggtttccaaagagcctggccttatccaatttgaacatcaaaggtctgcatattgtatgatgtattaatagttgatagttctaatatttgtatagtacttgacatataatttatatttgacacatgcatgtggactccctatattaacccgactcaagaaataaattcattcctggtgaagggtctgctgaatgtggacagaatatataatgaacagtgacactccaagctaatatgatttccacaagacctgaagcaatctctctaggacaaggaaatttgcctctttagtccagtgtgtcactgacaaaaagaaagaaaaagtaaaagggagcagcaagaaatgggaaggaggggcctatcacaaaaaggtttctgggtagaaatgtcacaatgacatcagagatccccggccatcagaaagcctagaattgtctctgccgcccaaacactaaactttctctccctgtgggccaacaattctggttcaaccctgagaagaacacaggctaaaaacagttctaaactgactggtattatttaaacagacttctcttccatgggattttaaattttaacatcttcagccattttaaacctaatctctccctgcttcctcaacacaaacacacacacacacatacgaaaaggataagttataagaaaattgatcacagttaaattacctgataatctgctgcccttgacagctgctgatttgcttgctgaacgtgcacctctgcattttccacattggcttctatgctatctgtaaaataaaacacacacacacaaatgtgttaaacatggattgatgctccagtaacaaatcactaaatttcattcaaggtaagattaaatatggtcattattcaaaggttaatagtagtatatcataaagttgaatttttttaagctggctttaagaattatagtatacacctatactatttttcaggtgatccaaacaatataagagcatttgtataacagaaccttaatcatcttcattacagagcaactccagctctacctggcaacccctgaaaagtactgtcaccctgacattatcaaatcagtgtcagcacaagagatgtctcagtgtcaaactccacagcttggtctatgtcaagaccaatgcacaagagatcaactctcttctttctactgctgaagattttgttcatcatgataaaaactggtaccttgacttttcaaagaatattatgtcctcagagggaaacaaacaaacagaaaaacccaaatgctaaaacttgatcccttaatcattatgttagtcattaatgtttctcaatttcttttccctctatgtctttgtaaatggaatgtaatttaagttactggagcataatacctatgctctacttagtttgtgttctgtaatggccgactcagtagcaagcatgtgacaatgtttatttaaggtaaatacagagtgctgaaggccatttactctgtggtcatcaacatacttctgtgctaaaatctagccctcaccgagggcccatgaagccttctcaattggtggcagtttttcttcccaccctccaggggcctggaggtggaacgggtgtcattttgaagcatgagaccctttgcccttgtctcttcctccctaccagctctcagctttaaggctcatgctatcaaactcagccaactctctttgttgcagacatctatcaatcgcatggccttttcttctcattccttgaatattttagcctctgactcactgatgctctctccaacacttctcttatacatactggtgacttcaagatccaactgctgacccttctaacaccctggcctcacagttcactgaccatactttttccaaagacgaacacctttcctcacccacccatttccatggtcacatcccaaaccctgacattccaataattgcagttgttccataatctcaatttcaagggtctcactctttgatcaccaccttctatctctagagctcactccttctaattccctggctccaacaattttcaactttcattgatcctaccacttcttcactgtccctcacatatggcatgtcctcacttccctccttaccctagccttagagtccttggacaatcacttagcctcagcttactctcatccttagcccccttgcccctccactttagtcatatgacaaaaccccaaccagtacccatgcagctgattatggatgtaaaaaggattaactgtgtttcactttaaagtcatgactgccaagcaggtctacttcatttctctgacttctgaaagactacgtcatactttctcttctctcctcaagcttctcaggcctcctctggcattatcattctcagcccatgaccttgatttccagctctttgaagcaacaggaaccatcagaagacatttccacacgttttcatgaccctatctacatgcaatatttgtgtgttctgacaactttcttgttgccaggaagaactatataccccgagcaagagccaaattttccatttgtgcactttatcacatttcctatcatttaactcaaaaacctcagtccagcaaacttcctctctctcttacttatcatcagtatttctttccctggtagatcaccttcatcaatcccatagctgccatcttaaaaacaagcaaaccaaaaacctctcatttattccacatccatttttgcagctatgactgcattctctgtttcacttcccctctttactccttgaaagagttatctatacttggtatccaccactgttctcctcccattctctcttgagcctacttttatcatgctttcacctacactatttcaccaacacagctcgtattgaggtcacctatgccctacacactgttaaatccagtagtcaaatcttaatcctcatttttcttggcctaacagcagcacttgaaacagctgaccatctattgttctggaagcactttttttcacttcccttctaggacgatgcattcatttggatttcctccatatcactggctattccttagtctttttatttgttcttcttcaactgtctgggctctaaatcagaggttaagaagctttttctgcaaagagccagaaaatgaataagctttgtgggttgtatgatctctgttacaagtattcagctaccccttcactgtgcaaaagcaaccataaaccatacataaatgaatacatgtagtttgaagacactgttctaaacatttagaggatccagggctaagtcctcagaccccttctattctctacccagacttaatccctggattatctcacccaatcttgtggtgttaaatactatgtgtacacagatcactcctaaatttagatcccctgcccagacttctcccctgaactccatgttcactttaataatgtcaagaaaaccttcacttggtgtaaaggggcacctcaaacttaacatattcaaaaatgattgatttatacccatctaagcctgctccacttacagatttccccatctcagaaaacagtaacttcaccatcatagtgggccaagctaaaaccttagcatcacccttaaattaactctttctttcacactcatacccagccagtcagtaaatcttttcggctgtccacttaaaaaatatctgaaatccatgaacttctcaccatccctctagttccatcctaatccaagccaacaagattgagcatctggatgactgcaatagccttttaggtgacctccttgcttttggtctttttccagcagccaagtgagtctttcgaaactgaagcagggttatagcactcttctgctcaactcctccttggcttctcattcgtttgtaaaaactgaaatcttcctacctgacatcatcccctgcacttggacatgatctccatctccttcttgctcattaaaaatgtcaggtatgcttctgcctcaaggcctttgtactcgctgttctctctgcctggaacactttctcttacttgctcccttaaatctaccaagggttcactaaaatgttacctatcagtaagtacctatcatacctaactaccctgtgtcaagcagcaacaatttccacccctagcagtcccatccctctaccctggccttattttctccatagcacttatcaccatttacttgcttttctcgcctttttaaaaaattgtctttcctcccattataagatcaattgagatagggtattttatctgttatttaatttcagctgaatctccaatgcctagatttgtgtctggacatagtagccactcaacatatttcggatgatgaataaattggtttttgaaattttaccctgtgatctactggggatacagaggagggtaagaatggataaaaaatagttacactgaagtaaaggtgcaaatatttcagttggaccaaattcagaaaatatactaaaagcatctttagacataccaatacatagctccagacttcaagatggtcaggatcctgatgaatgttaacaactacaccctaattgaaatgctattacattcaatacttaagggattcttagcaactttagaaaagaaaatcacttctaaaaagaattcctaacttctatgtaatactactaaattcatctaccaaaaagctattaaaatgaatgattaggcaaatgtctacctattccctaatacctaaaagacaagatgtcatgcacagttacatataccacaagtttccccaaaagtgcttagcatgatgacaaataaattggagtaagactaaaaccagaggccctggaaataagctggaataatgtttcatggtgccttccatggtcttggcagcaataggccctgattaaatttgggcttctgaaataaatgaagctggttatttcaaccagcacgagttaaaaatgagatctgttttagataatgccaagggtgatgcttactgtgttttatagaccatgcttttggttccagggaaaccaaaaaagggacagaaagtggttactcttctgtgagaaagttacagcaggtaaagtgcatgtagcttgctctcacctccaaaatctaagtcagcaggtcttacctattacatctccttgttcatgaatcatcattcccaaatctttaaatatttcattaatatccataatatcagcctaagagaaaacgcatatattattataatcagaaattcagtccccattccataaaagaggaaaaattttaaaaacccaaaccactactcacacatgggtgagcatgcatctataatacacaaatataatacataaactttggaaatatcaggaaaatatttgacaataattaagaagaatttgaacaatagccaccagttctctaaaatcagtttgtggcattaaaaataccaagtgagcgaggcaggatggaaatgaatggaaatgaaggatctataatagagaagagccatggattgctgagttcattttatacaacctgatagttttgttatcacaagcagtatctacttacaagggtataaaatattcttagcatgtatttctagtaaaatttacacatcaatttgacaatttaaagtaataaaacattaggtgtaaatttaaagtctcacattaataatttgaacatgcagtggattagtgaaatgtcactactgaataaagaagttataaacttggtgattaaatataaatttacttttcttcaatgacacaattaactgcttcataaagtttttataaggactaaatgagataattaacataaagaattcatcccacaagtgcctggcacatggaaggtcttcaataaattgtagccattgttagctattattagccttctttctaggaactaagtaggttccataagaactatgacttaataaatcctttagatctctttgatgtcataaacatagtaaagagaaataaaattctttgaaggccttataaaaggtcttactcatgcaggtatgatgtgtatcatgtgctctgggaagacatccagactcttggacagacatttatctctacactggtattttctcaatactaaggtggtccatagatggcttgatataacaataataatttttaaaaagctgcagtaggagggagtatgatccctcgtcctagcacaaacagtaaggacaatattatttttttaaaaaaggaattattccaactcatacattacaaatgctaccaaactgatacattaattttctttctctgggccagacatggtggctcacatctataatcctagtactttaggaggccaaggcaggcagatcacttgagaccaggagtttgagaacagcctggccaacatggtgaaaccctttctctgctaaaagtacaaaaaattagccaggtggggtgacacgtgcctgtaatcccagctactcagcaagctgaggcacaagaatcgcttgaagctgggaggcggaggttgcagtgagccgagattccaccaccgcactccagcctgggtgacagagggagactgtctcaaaaagaaaacaaaatttttctgtctcatgcattctcccagcattacctaagcatcttgagaacaaactcactaagaccagagcagcagcccaagtctacaatgtaagccttacttcaagttgcctgatagaagattctctctcatgaataagacggaggtcatcctctgtaatttcttcatcctgcacctgcacttgaggttgagtttggctaacagaaaaaaatgaatgtggaaaaaaacaaagattggtattcaaaacaatgggactcatttcctatttaagatatattcattaaataggatattttattctccaaagtcacagaactactcaaaaaaattctaagaatataacagatatattaataaaatttattcatttttcatttcacttatatcattttagctaatgtgagtttagagttattacttaattattggaagctgtatctgtcaactgggtatttcttctcagctgatttaaacctcatataagggaatgtctatattaataattaagtccataaacatttatttggaaaactttatatattttgtaataaatactttataattacttaaaatttttttcaaatttactctgttttcaacatataaacaacttaggatatttatgatataatatattgaaagctttaattctgttccagggaccttaatgtataaactttgaaaaattaccttttgatctgtaaaatgttttgtatttcttacctttcccaggatacaagattcctttcttttgagctgtcctcaggaaaactgccctgaataatttagtaacaggatggaatgagaaggggcaaaaaaagcaaaaatgagaaaaaataaacactcatattttcccttataataaactaaactgatttatgtacgtgtctgtgtgtatgtgtgtgtgtgtgtagagacagagagaaagaagttcttgttctaatttttcaggtcaactgcttcaagtaataatataattataagtaattttatattctaagtagacaagaaaggaattcactaaatattctcaaggatcaaataagtattatttagttaaagcttaatgtagtcttggaatccatatgttaatgaataagaaaataactcatgatagtttctaagggaatttaaaattagattaattcaaaattctattgtaaagcttcctttcatttattttctccaggctcatgttcattttcaatattgatacaacatacttgcgccattcatctccgtcatcttggtgtaatccaggaggaaagtgctttctacactagcgtgtacacaagcagaaagcctcagtaccaagacgatgtgagaatactactcaggatttgatccctaatcttttttgacaaaatatgtctctatatttttatatactctgtaatcttctgtactatgacacaaaaaatcaccaccgtaatacaaaattatcatccttttctaaaaatggagcaggaaagcataaaaataaatattcaagagctgatttccaagatattcacagatctttatgacttaaaaaattatgctactatagacttttatgggacccttagcaagtaaccatgttcatttctagaatgtcttttaaaatacttacagacactctggaactggctcttactcgagcaacaaactctttctctcgctcagcagcctgcctctggaccttctggaagtttgtcagtgatgttgtgaactctgccactaagcgatccttctgtattttcctttgacgctagaggaaagagaagaaaaagccaactagaatctagctgtgaagttcaactgaatttgcggtagttggctctttatttaaccctgaagttttcacttactccccaattacagggccttacagattaactctcagtaacattctgatagtatgtcaaatactgtgcatatttaacttgaggcaaaagacccattatgctggatttctcacctcaggttttcacgctgctaaaaactagcttattattttgaggctattttaaagtaattctttttcaggcaaataaagccttatacttttagctaagtaataacttccattaaataagcagggaaataaatatgtgcccccaggacacctcacatcttgaatgagcctgcatgttccacgcagtcagccccggaaggccaggaaataattactcaggaagcattttctgagaactaacttaattatgggtcagggcaaatgcatggaaataatttttgctttattgaaccacaggatactacctgagcaattaaatatagttttgtgttctgtgaactaatctcaaacagaattatttttgatttcctttctagcataatttcctttctagcgtaacagttcaaagatcctacagtgcactgggtttttttcacattcaatacatcaacaatgtgtcttaaagcttgatacctgttcactgggggtggtgggcagagatccaaactctttaatgtacttatctgtttctttggcaagctggttagtatactgctgcttctgttgcctaaagtgagaaaacacgcattacagccaaaggactaatatacttctttaagcttcaactctgccttttgaatcaacactgataaacagttgtacaaaaattgccttttcataaactggctctcaactttctctatcaaaaaaaatttcatatcctattctttgataaataatgagcaaatattatatgtcaggttcttcactcacacagggtaggcaagcttagagaaatcaattcaacggccatttagaaacacagatgacttgaatcagagggaacctgaaggagagactgttagatgtctgatcctttatgtttgagatactggggatgtggaagccctttatctgcatctcacacctggaaggtcaggtaagcaagaaaagatttgttaccttagactttgcccagttcccagatctagttatatctggcctctcttatttctctatgtgaacatgtatatgctatagatacttaaaaaaaaggcgggggggaggggccaggcatgctggctcacacctgtcatcccaacactttgagaggccgaggcaggcggatcacttgaggccaggaatttgagacgtgcctggccaacatggcgaaaccccatctctaccaaaaataacaaaaattaggtaggtgtggtggagcatgcctgtgatcccagctacttgggtggctgaggcagaagaatcacttgaacatgggaggtggaggatgcaatgagctgagattgcaccactgcactccagcctgagcaacagaggaaaactcttgtctcaaaaaataaaaataaaaaggaaagaggcaatattggtacaaatttactattatttaagtttacgctggaaaaaataatggcatttccttgtaaagggaaagaacacaataaataaaagaagtaaattatagtcatccctcagtatctgcagattggttccaggacccctgtggataccaaaatccgctgatgctcaagtccctgatataaaaaggtatagcatttgcatataacctatgcatatcctcccatatctttaaatcatctctagattatttataatacccaatacaataatgtaaatgctatgtaaatagttgctatattttatagttcagtttttttttttattattgtgttgtttttttttttttcttgaatatttttgacctgcagttggttgaatctggggatatataatctatggatacagagtgctgactacatatccatattttatctagctatcttataaattgaaaagatttccaacttaaaaacatgacactaaaaaaaagctcatattaattgtgatgttttacaaatcacaacatcagtacctcttatatatttcatctcattttaaatatggtctggtcacacttggggtcctttaaaataatgagatattgtataagaatatgcttaagaatagggatctgtatttgactgacaaagggtaattaaaatctatttctatctctatttaccaaataccctatctttaatgcatttttgtaaatctctggaaatcataatatagtcaaagttttaaaaagaagaccttaggctggacatggtggctcatgcctgtaatcacagcactctgggagggtgaggtgggtggactgtctgagcccagaattgaagaccagtgccggcaacatggcaaaacaccatctctacaaaaaatacaaaaattagccaggcatggtggatgtgcctgtattcccagctacacagtaggctgaggtgggagaatcgattgagcctaggaggtccaggctgcagtgaaccgtgataatgtcactgcactccagcctgggtgacagcatgagatcctgtctcaaaaaaaaaaaaaaaaaaaaaaaatccttagtgactacggatatatattcagaatcttcattattaactctatcaaaatattagaacttttatgaattatgtacttctattccattttactttagtttaatgaattgtggtttattatttagatttggagcatttttaccattctgacacttacccactgtggaaaaataaaatataaattagagataattgtaagtccttcaaattgtacttcctaaaaatatgaattcctattacctatcttttaatatcgtcctctttgcagttttccctctatagttaatgttgtttagaagtattgcttactagatatatgtgacttgaaatttacagctgtaacagtactgaaataaaatttaagagttaagttctaaatgacattgggtaactcgttaaacccgtaagagacatgaacaaaatggaaacagttcttttggtctatttctcttactctaattctgtaaggtttaaatgataaaatatgtaaaaatactctgtaaaatccacaacataccacagacaaaatattatcactatgactgctggtcttctaacagcatattaatttactggaatatgtactatataattcattataacttttttttaaacggaagctaatgctctctgaaattcaaggatgtaggtataaacttgtggggagacagctcacgtagctggttatgtattggatctaaaccaaataaaactctggtgactgcggggatttttagctatggaaagtaaatcacataaattgagatactagagtataatttttcaacagctgtcaaaaacaacctacctaaaaactgtaagaaatgcaactaaagaaattctgctttgatagggtaagcctatcaaggaattttttttttttttttaagacagagtcttgctcagtcgcccaggctgaagtgcagtggtgtgatctcggctcactgcaacctccgccacccgggttcaagagattcacctgcctcaggctcctgagtagctaggactacagaagctcgccaccacgcctggctaatttttttattttcagtagagacggggtttcaccatattggccaggttggtctcgaactcctgaacttgtgatctgcccacctcagtcttccagatctttaatataaaaacacctgcctactccagacagggaaaaatctacacaaaagcttggtacaaatgtatggataaggtagcagaaaaactccattgtttttccattttttcttccagtaaacataatatactacatactgtaaaagcaacagaataatagcaatagagttttttctttctcttttatttatttaactagatacttacaactgttgcctcaattcaggtgaatcttgaggtgttccaagttgattcagagttctttgtatttccacagctattataatagaaaattcatgtattaattgtcacaaaagttaaggtaacagaaagagttaaaaattaatatgtacaagcaattgggcagttgaaaagagacagaaaaacaaagatgaaaatagaaaatattaactggaaaaaagaataactaaatggtttacttaaatctaattagtaacaaaaattttcaagaggaaattgtgtgagaatgttaacttgtgaaaatgcacttatgacccaaaaatactatcttcttccttatcccatcaggatattattaagtaaatacaagggcacacagactttaacactactagcataaaaattgtgaggaaataagtaacaattacatatttcattagaatataatataaataagttattgttaataaatgagaggaatagaattacaaaaaatcatttttcaattatccatgtaataactgatttcagcaaggtcatcaaaaaatgctaaaatcacaggacattcatacaacttaaattaccaccacacagatgacattaattacaaaagatataactttatcatatataaatctgttgtctgaaaacaaatgaccaaatttagcagtgagaatggaaaaaactgacattatgaaccttgtggcatgctgcagcgagaaagccacaatatgatctgaggatttttcttgccaaaatatttaacatgaatctaatcacaaaaagaaattagaccagtctagactgtgggacaatctacgagataacttgcctgggcatttaaagacgtcaatgtcacaaaagggaaaaaaaaagttgacaaagacagaggtgctttctaaattaaggaattaaaatacccaaaagacactgtatgatttttgactggattctgaatcaggaaaaaagcaagcactataaagaaaatcatagggacaactggagaaatttgaatacagaaagtaaaaaacacattaaacaaaagttgaaaaatgcccacaactggcaaatccaggtgaaaggttcattgtactatatacttatatatatattttgtgaggtttagaaaagattttaaaataaaaagtccagggcttaaaagtcatgttaaactcacaatccggaagtctatgactattgcaatttttttaaaaaaggctctacacaaaaggggaggacctacagttttatgtatgtggggacataaataaaatgtcatggtacataaataaaacgtcaagtagaaataagctgaaaatccaaagaactcttaacaatctaaccccctcattctttttatttaaatgagtggtttacttatatagcttaaatgctttaaaactattcattatttacatgctcaagggaatgataaagtattacaaaatgcaggataattttggtcaccgcgaatgatgtaataaatactgcttttaagtgaaagctgaaaaacagaaacactagagaagaatcaaagcatatagcaactcttagcatttggctaatttaataggaatttatttttgctttttgggggttgatttttcctttcataagacaaacaaattttgtttgccgtgtttaacttatggctgcttataattagctatatattccctctcaacctcaacagattttcttgaactgccttataggggctttattttcttaagcgtattgataatacaaactgtagtatgggcatcgatagactattggcaggtatttatctcaactctaaagtgttattgttctttaggaaaaaatcatagcaagtgagaaaaaataaattatttaataaatgacaccaggaaaactgactaaccatttgggcaggggagaaagaaccctacctcccagcatatagcaaaatacatttttaataaaccattaatttaaatagtaaaattgaaaatattaaactgctctaagaaatataaatgtttttattatatgatcttatacatgatcttggagtaagagatataaaatattagctaagcatgacacaaaactaaaatccacagaggaaaatattgacaaatttgactacataaaataacttggttaaatgttatacaaaaaatgtgtacatatatcacaagtatatatgtaagtgtgtgttcatatacacacaggagacagtaactgcaggttatgatgaggaaagaggttaaactacaatggtaattatttttggtaacagaacaacagcccagtaaaaaatggacaaaggttataatcttgcaatttacaaaaggcaaatgtgtacataacaaaacttcaacttcactgataattaaacttttatgtttctgattggtaaaaattatgaaaagcagttgagaatataattacaatcaaaggccttaaaaacaaaaggtaaagactacataatatataagaaagagggagcaatagtcaataactataaataatttagaaaatgtcagacaatccagtagaaaaatgggccaagacacgtgtatatctatataacaaacatgcacgttctgtacatgtatcccagaacttaaagtataataaaaaaaaagaaaaatgggccaagaataggaactttaatattcatgaataaactgaatagcaaaaaaaggaccgaaatgcatatcaattttgcaaagtacaaacaagtacaccacatgaatgctatataaaattactcagccaattaaagaattgagtagaaatggattctgacaggcccaatgggagcctagttccaccatgtggtaatttccggtttctgaacagatatactgagcaacccccagttctcactcatactccctgagtaagggctcttatggaaggaagaaatcattggaagcccctggggacccactctaataaaaaaataaaaccaagggcattatctattccctgggaattactcagaaatgccaccatcaaggacagaaagagcagggagtggacatgcctctcattcccatttaaccggcctatctggagaatgcagaaggctaatgctcatgataactagcaaaagcttattcaggtggtgactccaactgcactgttcctcaaaatgtgatggatttactacaacagagcatcacaatctctagcaacctgtatatacctgcttatatggcaaatactttttgctctaccctaaaggacagagaacatgagaaaggatttgctatcaatgggatgggacatcagcgagccttcacaggcttatctcacggttatgcacactgtctatctttgtactacaatttcgttgtcaaggatacggatcatctcctcctacaggacactacattagtccaatacactggttacgtctgcttttaggaccagaaaagcaggaggcaacatgtactcttagatgcctgcaaagcataagtaagccagcaggtagaaaataaatccatgaaaatacagggcagtgtttcctcagtgaaaaatcttggtgaattaatctgtagataactggcatacttctgcaaagtgcttttctttgtagcctcaagtacaaatgagaaacagactttttatgctgcttccaccctttactgaatgacccaaaggttaccagctttagcttcaactcccaaaaagaaaagaccatccagcgagttcaagtggtggtataagcagatctacaacttggctttaatgacccagctgatgcaatggtacatcaagcctgtgcaatttcagggcaccgaagaaaactagtagcaaatcccaataggaaaaacacaggggtcccttagaatgttggagcaaaaccttccttttgagacttgttctggccttgctactgagccctggatagaataaacaatggtacaaggtaaccaagtgactctagctgttcaccatgaattgtatcttgttggtacagcctttctacattttgctctacgtatgtcagtcagcctatccctcaccccaactcctgaagcacttgttcagtgaaataataaactagcaatggctgtcagaacaaaagccacatatagactcaacaatatggatttcctcttactcagactgacatgaccatgggtattgccgtacaccaatttgcagcaatagcaatctcatgttatactctattaaatcatttttgtttgattttttgtattaattttttcattcatcctttggacttcccagatgcacatccatacgctctacagagatgattttacccattttattttctatggctaattatctttacaaacactttcaataacgtgctaatttaaaaataaaaagtaaactagtgatgtgccgttgttgagggttgacccaactagctgctccttccatcttggaggaggcagaattttatattcacttcaatggtattactctgggttctgttatgcatcctctaagcacccactgtgccccctgtggcccgtccccactcccccgaccccatgcttctaccagactcctaatccacctattagtcacaatcaaggtgttccacacaccgatgcttctgctcaagaaattacagagaaaaaaaattaacggtgttccaaggacaatgggattcactgctctgccatgtattctgttatctagaagctgctggacttctagaatgtttacggcctactgagactcaatcctggcaccacctgggagacaagcatcttgggaaactgaaggatccttatggtctcaaagaaccaccactccatggtgctgtttcacctacagccagaaagaaacttggatttgggaagtaacaggtcgaagtaaagtccaatatttcacgattacacctaattatccatttgtacaattttttccatctctcaaggtgacttagagacaacatccaagggaggaaaacaatcacgttttcaagactacaactggtcatttagggccaaggtagtatgttgattgaggtaattattaagcggaatttggggtacgctcatacacaagtaaaagggagatgaactggagggggcctgataatactgccatcttcactcataaaagtgagtaccacatagcctgtgagcaggagcaacaaggacccagggctgaaaatctgggttatcccaaacagcagaggtgctgaaagaaggcaagaggaaagtggaatggttattataacaggaaaatagtaatacaaactgcagcctgtgatcagttgtagagtggtaacttagcacctgccagtattctttttcttgctctgcaatgtatatatttagatatattaactgttcgtctccttccctatttcctccactgttatatatagaatgtaccatttgtggttactctgagacactgttccacaggctaaggaatactgctgttcagttttgctgaaagaggaggagcacacaggaaatcaccccctaaatttggcattggctacaggaactgaatagacctcagttttatcccttctgtggaaatgggaaaggagttctcgttgcatgagggatagcagcagtgtgtcacgcaggagcttttgtttttaagcttaggtatgaaaaaaggaggcgtgttcactgtagaaaacaaaagggataaattatagtgaaatttattttgggccacctaatacccaaaactactattagattgggatctttttggttataatatgaccactgagaagtagcaccacagagccaatctttggagggggaaaaaaactggttgctaaagcaacaaaactgttttaagattctttgaacattgcttaccttcattatcatacaggtgattaataatgaaagtattagtcactatcactaacaatctagttataatcaaaagctacatttactctgtgcttttggttttgtagatttaggttttatagatactgaaatttcttaaaaatcaaaggctctggctaacaacctccttgtcactctgaaacaattttttaagataatacaatgtctcataaaatgaagcctctcagaaaacaaccattatgttattgcctaatagaatgcatttaactaatgagagcttctcatgaacagaaatggaagacaaggccccctacacttatgcagcatacaaactagaaaaggacaaaaaaaccccaaaagtacaaacaccatataaactcaaagagggtgcagcagcaacaaatgctataacaatgtttcaaacaatgacctataatatgtgtgttctattggaggacaatccaaaaagctgtaatgaaggtggcatttgtaatggtttgaagggtaagaaataggacatttcagtttggagattcaaacctctaatatcatactcagacctacactgaaatgatcagaatacctattagtcaccctaactagaaggcaaatttcttgaaggcaaggcctaagttttattcattttggtttttccagaatttatcatattgttgaccctcaatgaatagttttatgagtgaaccataaaaagaatactgggaagatcaaaacgtacgtaagaaataatatatatttctaaaacatacagcataaataaatggagagttaagaaaggtagttatgcccatttattattcattcattgattcactcgacaaacatttactgggcatctgctacgtaccaggcacagcgagagggcttctgaacgtgaacattaatttggttgcattcctttaaattgagcaggtctacacttgaggatcaattaaaggcatcatctgatcaggtgataaagggcttataggaacataaatctgaaactactaaatcaaatttggaaaaaatattatacggtattagttcaatcctattttataaacaaagaagttgagaaccagacagaataacttgttccaaaaactatagctatttagtacaagagctagggttagaatgtagatttcttggttttcaaaaaacttttttcaatgtgctaaaaggactgaaagtaaaagatgttaaaacacattatttcataatccaggtgtgtgacagttgacaaagcaaacaaagaaaaaataagtgtgtctagattgaagaagtaatttgaaggagttgaattgagatgttagatgtttccagcagtgctcaaagtaagtttaggtctggcagtggatcacaaggatccttcttcccagctgaaagtgatcaaggaagaaacgcctgctctttctctgggttttatgaactgccaagattccacagacttgattttatatactactagcattagcctcctacaccagggtcaacaaattatggcccgtagagcctgaaacctggttttgtacagacttccaagctaagaactgttgctacagttttaaagggttaacaaaaaagaaaaaaaaaaagaaaatgaaagaaagtctaaaagaatctgccctttacagggaaagttggccagtctttgtcctcagttattaaaaattactaaaaccttgtatttaaaaactcaacttggcatgttatttgaatgtactgtcatccttcactatccctagaggattggttccatgcctccctccatccacctcccaaagacaacaaaatctgcagatgctcaagtttctaatataaaatggcatagtatttgcatataacctatgcacatcctcctggaaatcacctctacacaacttacaatacctaatatataataaatgctatgtaaattgttatagtgtactgtgttttatttttaaaatttttctgaatatttttgttccatggttagttgaatccatgcagaatccatggaaaaggagggcctactgcagtcactgcattaagtctatctagtaaaatatttaacaatgtcacaaaatttccattgaacatgcatgtacactgagttgaagttctttgattctcagaatatgctattcacccatcataggtgctggcttgagtacctcattttcatctgctgctcttatactaatttagaaacaaaacactttttcattgttttggatgagcatttttatagcatatttgctgcaaaaatattgttagcactctatcatgttattactctctggtttttggccatctcctaagttcttccccttctagaaggtatggatagtaggatatgtggttcacaggatcttctgcgacaccccaattgaccatgttcaaaaatgcttgagaaaaataagcttagagaaagggagataagaggtttctagtcagatgacaagcagtatggtgatctggaaaaataaataatcctcctactttctcccaagtccagtctgtaggatttcacttcattatctagccttaggtgctatgaatttataggacagtcatcttctattttgattggcataggtccaattaaagaaaaaaactcatgaaacaagccgcagtctttccaaccataaaaagaattaagaataaacagtttcttgaagaaaagttcatctaatgcatacaggtaggattaaatcaacatgtgtctctacgagaatacaaagaaaaaattatttttgcattatctacaattttgaactatctgtaccactactcacttccacagacgtgacttcaaagagtatgttacatttttcataacagaaaaataataccatttcctacacatccgaaaaagatgcactactgggtcatcaaaaacaaaacagtgtcccgtttctggctcttctacagcaatgaagatccattctgttccacgtgggtctgctgccatctagtggattatttaagaaaaaagctttacagtaaagaatagtttgtcataaaattgtaggctgaatttggtatcaggggctattaatacataatgttaccacccgtcagacttcaccagcaaatggatgctgtctgacaaatgagactggccaggctgtggcggcatggcagatcaacctaacacacacacagagtacctttaaagaactgtctccaaataactaagaatagctatcttctcttttagcagaaaacatctgttttcaacgtaaaataaccaacttgtaacagccaaacatagaaaaaaaaataatggttagtaaaatccctggacaggtgattttgagattccaacacagactcagccacatcacactgaggaagaagtacaattgaaggctgaccagcaagtagagttggagccagacagcctgatatctcacttcttcctggctgctgaccctgggcaatttacctaatgtctccaagctataattgcttcaacagtgagaaagcacctatttctcagctgtcataaactttaaccgagaacaatataggtaggcaccgtgtactggatatagtaagcgctcaacagagtctgttgttctcttgaaggtcagaaatgaataataggaatattcttattaacgttttttatttaaatgccactttattgaggtacaactgacaaagcgcataaactatagttttacaagtttggacatatgtgtacatctgtaaaaccatcatcacacttaagacagttattagattcttcaccctcaaaagtttccttgttgtagtttgcaatttcctccctcctgcatatctgttccttcccccctccatcaccaagcaatcactaatatgctttctgttgctttctgtattttgcattttctaaagttttatataaatgtaatcacagagtatttattcgtttttgaaaaaggatggtgtctggcttaagttagcctaattattttatgattcatccatgctgtgtatatcaatagtgcattccttttattgctgagtattccactgtatgatacaacactattgatggacatttgtgttgtttcccgtttttgtccattacaaataaagctcctataagtatatgccctacaagtctttgtatgggcatatatttaatttttgtgtgtggataaatagaagtagaacggctggatagtatgacaggtgttacatttagctttcttaaatcagtcaaactattttacaaagtgatgccactttacacttccacctgcagtgtatgaaaacttctgttcctctacatcctctccagcacttggtatgctccgtcttttaaattttgccaaataggttaatagtggtatccgtgcttttaatttgtattttcctaataactaatgatgttgaacatctttttatgtcctatttgtcatctgtatatcttctttgttgaagtgtctgttcaaataacaatattgtcttctgatccatgatcaaggtatatcttcccaattatataagctttctttaatttcagcaatattttgtactgttcagtgttcaagtgtttcacttatattgccttctaagtatttcataatgtttgatgttattgtaaatgccagctttttaaatttcaaatttttattttgattgctcattgccagtatagagaaatacaatttatttttgtacattgatcagatacttactaaattgacttttttattctagcaggcttttttaaattgtagattccatcagattttctacatagacatttatgtctgtgaatacaaatggttttaattctttttttcctaatgtgaagtccttttatttgtttatattatccatctgcactagatggatcctctagtacaattctgaatagaagtggtgagggcaagacatccctgtcttgttcctgatcttataaaggaaagcattctgtctttcaccattaagtgtgacactctgtaagttttcatagatgatcttttgtcaggttaaagagctcacttctactcctagtttactgagaatttttgttaggaatggaagtagaatttgtcaaatgctttttctgcatctattgagatgattatataggttttctttttaagtttgttaacataatgaacaatatttattgctctttcagtattaaaccaaccctgaattcctgggatatactccacttgttacatccttttaaaatattggtgatttgattagttaaattttgtttaaattttctgcatttatgtcatgagatgaaatggatgtgtagtgtttttttctgggttttttttttttttttttgagacagagtcttgctctgtcatgcccagcctggagtgcagtggcgtgacctcagcttactggaacctcctgctgccagttcaagcgattctcctgcctcagtctcccaagtagctgggattacaggtgcccgccaccatgcccagctaattttttgtacttttagtagagacagagtttcaccatattggccaggcttgtcttgaactcccgacatcaggtgattcgccagcctcagcctcccaaagtgctgggattacaggcatgaaccactgcacccagcctagtagtgttctcttcttttactgtctttatctggtttcaatataaggattatgctgacctgctaaaacgaattcttcaattttttggaacagtttgtgtacaattagttaaatatttgatagattacattagtgaagatatttgagtctggttctttgtgagaaggttttaagttgtaatttcaatttcttgatatagagctaggcaggttactgacttctttttgagtgaactttgataatttgtgtctatcaaggaatttatccatttcatctaagatgtcaactttattgtcataaagttgtttataatactctcttaattgcagccataaaaaaaatgagttcatgtcctttgcagggatatggatgaagctggaaaccatcactttcagcaaactaacacaggaacagaaaagcaaatactgcatgttctcactcataagtgggagttgaacaatgagaacacatggacacagggaggggaacatcacacaccagggcctgtcaggggatgaggggcaggggagggagagcattaggacaaatacctaatgcatgtgggacttaaaacctagatgatgggttagtaggtgcagcaaaccaccatggcacatgtatacctatgtaacaaccctgcacgttctgcacatgtatcccagagcttaaagtgaaataaataaaataaaaaccatttcaaaggaaaaaacctttaaatatatgatagattctgtaatgtacagaatatatgtaaatatgtatagatttttacatataaaatatgtagaatttataatatatcatctctctcattcctgatattagtaatttgtttcttctatttttttcatgttcagtctggttagatgtttatcagttctattgatctcaaagaaatagcttttggtttcattgattttttttctcccttcgatttccactatgatttgtatttcctttgttctgctgactttgcaatttcggttgttttttctaaatttcttagggtgaaaactgacgtcatgatttgagacctgtcttcttttctaatacaggtgtttagtgctcccttaagtactgagttaataccatccaacaaattctgatatgtgatgctttcatttacgttcagttcagaatattttccaattcctctttttggctttctctttgatccatagcttatttgaaatgtgtttggttttcaaacattaggggattttccagggatctttctgttactgagttctaatttaatttcactgtagtcaaggaatattatcttgtatgacttgaatcttttaaagtttgttgaaactcttgattaatgacaggaatagagtctatcttaataaatgttctgggtgcacttgagaaaaacgtgtgttctgctgttgttgaatagactgttctataagtggctgtcaccatcaaggtgattagtactttgaatcttctgtatcctgattttgtatctacttgttttatcaattattcagagaagggtaccgaaagccataattgtggctttgtctattttccttgcagttttgtcagtgtttgctccatgtattttaaaactgtcttatgagggagttctcagttttttttaagtgttcagcttcttatttacatttcttgactatctaatgtgaaccatacttgagtgctaatacttaataatctatgatataattataagaattgtagagatgataaatatcaattgacaaaagatagttatagcccgtaattgggagggaggagtcagctactatgtgccagtgacatgtatctagcagttgcatataagtgacatatttaaaacaggactagaaaaaaaatctaaatattgaaagaaacaaactctgttttagactccaatctttcctcgtctatcaaaccctctagctttgttagagggtggtttggagtgttaaacaaagtgatataggccaggcgcagtggctcgtgcctgtaatcccagcactttgggaggccaaggtaagcagatcacttgaggccaggagttcgagaccaacctggccaacatggcgaaaacccatctcttctaaagatacaaaaattagccaagtatggtggcacacccctgtagtccaagctactcgagaggctgaagcacaagaatagcttgaacccagaggaagaggttgcagtgagccaagattgtgccactgcactccagcctgggcaacagagtgggactctgtcttaaaaaaaaaaaaaaaaaaaaaaaaaggatgatatatatgtaaacattttagaaatggcatagatctttgtaagaataaaagtacaagatgttattactaataagtcttgtacaattagagttaggatccaggttcgttatagggtacaatgtgtagagaaaaatgtatcattagaaatacccatgtctatctatttttcaagaaaaaccaagaaaagtgtattaaaattctaaaaagtgtatcacaagtagaaaaacttcctggagaatgtgaaggatggctactaaaataattctggcttttcccctctagcactagtatatctcatgctctgtcttatgacctgaagagaacacttgtcttctttgtgagcaaaagcactgatccaaactgcagagacgagaaagtgtgggaagggagatggagaaggatcttctaaaggatgagtctcgaggctggaagctcaatggagagcatccacccgcaaggcccaactacactggcttcctgtgctccccttcccagcacagaatatctgaaggcatagcccgcttccacaaagcaatctcaaatttacaacacacttaattttcactttgtcattggttctcttcccggatactttaaaggtagaaaggcataaaggtcaaatcagtggaaatttgggggcattttaaagctattgtagattaataaagggttaaatctgagggcacagttcttaaaaataaagtacaaaaacaagtcatctaaaattgtatgtaaacaataatttggacttctagatggctggaacattacaagctgggtcttttagcaaatttattcatcctaacatttttcacatggatctgctcagtttacctgctctgaggtagtctggaatcagaagcaacaacggttccataacaatgtgatttgtgtaagaagcaaacaggaaaggactgggcagtggtgaggccttgcgccttgcaattccccaaccccgctgacacatcttttgcccatcatgatgagcttccttcctgtcatccactcgagggcccaataattctcctactgctccaaaagcagctgaattgttgtcacgagttcccctctagtttacaggcagtgattcccaaaccttttacttcagtcatttctgatcagttctaactgccaacacatgctggcagctgtttctaaaacactgaaaatcgatttctgcttcttatagaaacacggtagaagcatgtttctgaatattcctccttcttccctcctcaaggcatattatagaatgggggagcaggtagaaaacccataaaaattacattttcagagaaattaacacaaaatgtgtaaatatgaccaaattctcaaaaacgtgtacatacggccaaaagcaacagaaaatagcaggtcctgagcaggaagccgtatgggtggggcggagaataaccggggttgcagagctccacactgtcaccagcaaatcatcagaagagctgatcccacccagagtgagaatgggcagaagcagggctgagaagcaccggggactctgctggagaaggtgggaaaaggagacacggaacagattcaggaggccatgggctgccgaccctactcaaaaaccaggtggggaacaccttggaaagaggtgtctgtgcatcttggggccgatgaagtgattgggatgacatcagggatggagcgggaagccctcctacaccaggctaggggctgagaggcagaggaggaaagaaacagtccctcagtgcagcacagcacagcacagcacagcacagcacagcacagcacagcacagcacagcacagcagagagaatagagcccttgagcagagaaatgggcacttccctctccctccacaggaatctcctgccaggaaaatcaaactcattccattgaaaaacaaaaaaaaatggggagagtaaccacacaaaagactattttaaaatgtggaaaagaacagtaaaactccctaaaagaactcacagcaggagaacatgttgccacaaagtgaatatggtaaaaattataccccaaaatacccacaggattaaaagaaaaaaaaaaaactcaatgaagtaatcacagtttaaaggaagatcacaaaagaactcttaagagatggccagataacatgcatgcactgactaactagagactgaaggaactcagaaaagaaggacaaattcaaaaataaagaccccatgacaagaagcacaataacagacagacgcagaacacatcaggcctcatgatcaccacccactgcaggtttagtcattttaggttccttgggccgcccctcactcttcattggttgtagtttctggctcgctgccattctgtccaacatgactcctatcttaatttttttgtgatttcaatacacaggctgacgatccttccaccatcctgctggcctccattctttgcacacgtctcctactgaaatgattctgtcctccaccctccctcagccacacactccaagatcccatcaaacaccttctcattaccaggaactgtcactcttccataatcttggtttcaggcaatctacttagaaatcacctcctgcatgtccagctcactcccctggccccaactccaacctgccatccattgatcctgccactctgccacatttcctcacctccaatgtcgtcacccactccctaaccaacttaaactctggagtcagtccatatccagactcttgcatatatcttaagcccctctctcccttcttaaccacttgacaaaatctaaaattctggttgagtccaacattgcactgcctctgcaccagcactgcactcctctcctcataacccttgctccacccagagtaaaagtccttacaccagcctgcaaggccctacctgacctggtaccaactctctctcttccctcctctccattcctctaatggccaggggtgcttaactctgagggcccatggacatgctatttccccatctaaaatactctttccctagatactgtgggacacattcccttccttccttcaaatatgtgctcaacgaggaactcctcagtatggtccatcccaactccccgtgcaccctatttatcaaatgcaaacccctctccagcacatgccggtatgtttttgtcattgtttctttttgtaacacttaacatctccttctaacatatgacataatttacttatttattttatgtctgtcttctctcattaaaggttcactccataaaggcaggtatttttattttattcgctgacatagcttcagcatccagacagtccctagcacatcacaggtgtttaataaatactcacacagggaatgaacataaatgcacaagtaacaccctggtacaatatacagcatgatccaaatacaccatgttatatgaaccagactctcctgggctcaaataccagctttgccacttaacagttgtacaaacttgagcaagtgacaaccactccaaacctaaattttctcacctgaccagggtgactggaagatcaaaagcaatgcacaaaaaaaggaataaaagatacctaatacaaggcacaaagtaaacagttaattaaaaatagttttaaaatactagcttacatatcttccagaaagagattattgaacaaagcagggtatataggaaataccatacaactaaaatcactgggtgtacttgggccaccctgccccactctcctcccatgcccagcagcaaggcagtgtactgggtattcacaaataagcaggccttggctggatatctgttgaaggtttccatgctcccaagcaggagaacagtccacagactaggacagtatcttggtgatgtctgtgggcattttctttgactttatatggaataaaaggcaaactatcttaaagaagtaggtggccatactcaatatcattaatacgtaacttcaaataatgataatgataatgatactataatgagaaagaagagtaggaaaataaatgtaccaagacttgcagaataatatcttgtatgacttctagttttttcctaagcaactaataggcacaccaattaacaattgctttaagaaaaaaagtttggattaagtataaagggcaatcactgtttgatatggtttggctgtgtccccacccaaaccacatcttgaattgtagctcccacaactcccacatgttgtgagagggacccagtgggagataattggatcatgagggtggtcattcctgtgctgttctcatgatagtgaataagtctcatgagatctgatggatttataaaggggagctcccctgcacaagtcctctcttgcccatggccatgtaagaagtccccatgcttttccttcgtcttccgccatgattgtgaggcctccccagccatgtggaaatgtgatccattacacctctttttctttataagctacccagtctcaggtatgtctttattagcaatgtgagaatggactaatacactgtttaataaaaacattgttcagtaattggtgaaaacaacaaaaagggatcaaagagatgaggaccataattgccaaaatcactacaggaaaccaaaactaaatgccaagcttaacttatactgttcgattcctacttcagcaccaaatcaaccaaaatgtacagagggacagcctcacagggcagttgagtagccactacacaactaaccatgaatatgtgtaatcaaagagaaactaccctgtcatacaattactgagcatagatcatgttggaaaataactagtcattattatagaaattcttaaataaatgtagtatcaaaacatacacatgaggatttttatcacatggtcaccatgacactttatctacagagaactcagaggattcatttgtggaggcaccacaaatggttaggttctcaggtttttaaacatatacacttaggataaaatgtctgttaatgaaggattaattaaaatcatttaatggcataaccacataaaaaagtaagcaaccaataacaagagaaaaaaaaagtaagcaccaaaaaacctgtatagtgtgatctcaatttcattaaaaaatgaacgaataaaattatgtgtaaatacttctgtagccaagacatgagccctttatctctgggggccaaggttttagtaggaaagtaaaaaaataagtaaacaataatagtactttaatttactgataaaaggcaatataaaaacaaaacaggttaatgagaaaaagaatgactggaggaagcaaaatgataaggcagggaagacattgctaaacaagtgagctttgggccctaagacctgaatgccagaaagaaaccagttacatgtagatctgggaagatgtctgaagcagaagaggagcaagtgcaaaggccctgaggtgaggatgagctgactgttcactaagcagaaagaagatctacctggtggaatgtggagcagcagagcagcaccatgggagagagtggtagttgacaagtgggggcagggatcagatcttgaggatattgtggggcatggtggggatttatatctgattataaaagccacagaatttaactgttgcctttcaagctataggatgacatgatctgatttacagttttacaggtttaccttggcaactatttggagaagacggaaagaggcaggaatggaagtgaggagaacaatttggagactgcagtcatccaaagaaatagcagcagcttgagcatatgtggtaatggcagagatggagagacacagacagatctgaccggtagaaccactaagatttacacttagattaaacagagggagtgaagacacccattactatggtttggggttggaaccaagggtaagaaagttcatgttcagggcagaagcatatgtatggttcacagataggagagtgagggataaagctccttgaagcatcttggagccacatcttaaagatttagttcataaaacaaagaattcactcatatccggccataaacaccatgttcagtcataaaggaaaagtcactgaagagaagaaaagttgtcacactctgttaaaatttccttggacaagatagcaactttcacatctatctctgttttatgttagcaccttaggcatgaagaaaatcacaatgaaataaaaactactgaagtttttctcctctaagtgggggaaaaaaccatccaaccacattttcagatgtgcaatcttagacataaatatttcaaacagcattttaggaggagggaagcaacaatttttcaactctttttcctttaataaactgccttcccatcccaccaacagattaccccagaaaaaaaggaaacattcttaattcctgagtaaatatatggttccagtaaattcattaatttctcaggactggagctccttttttaaaaaaatatttgccctggcaccaaaaaaaaaagtgataatattagcttcccttttgtgcagtcatgtgttaaaatgcaaaaacaagtgtccccttcaccagaccctaactaattaaaagaactgtgatcattctaaaagtaacaaaagggctcacacttttacatagacttttaatttcatctcaaagaaccttatggggacaggagccatgcaccaattcttaataaacaattttgaaaagtatacttgcagcataggaagctaattataacacagagaaaccaaaaacatctgtttcgattttaaactaaagtctatgctgaactaatacctttaatctgtaggagagatgattaaaaatgaaacaagtgaagattcaacaaaaatatttttcagtcaccttctcttagcacttaaaagcttacgttcatactttatgtgcccctagaaggttctgtctttccaaattttctggaaaaaacacacatccacaagcccatgtgatacatgatgcatattttagcagaaacttctatactcataaattctgatgagtagattttatgtttccaatatatctgttttattcactttccaactttagccacactacatcttcctctttcaggttattattttaaaaaaaaatactcaaatgcgagaattcacattagcactagtggaaaggcttactatgttatttaggagttagggaaatttttatctcaaggactgtgtttcatagctattctcatttctattcaccaatttccttcaatacaaaattttgttaattctgacaggatacaaacctctgtgccccagctttcccatctcctaacacttaaaaataatacataagccttggtggaactctagctagtcttgagtgtgatggcttcttcaattatgggattttatgagcatgcattatggattcagatatggcaatcagcctcttaacaaaacatagaataatcttgtacctgttagaagagtttcgggactcttaaaaaactttggttagaattattgcctgttaaagtttgaagagaccataacctagcccacagaaaatacacatgagaaaaccatgtcttggaaggttcgagagcttactcaaggtcacaccgctatttggatctgatttcaggaaatgtacatgcaatcacatacagcttgcttgattagaaatgtttccgattatctcattgatttctttagctcagctacactctaaaaactctgattctaatcagagaattgcaaagtaaatcatgagaaacctatgactaaaatgaataaaaagctgtaaacatcaaatgttgacaaggactttgagcagcacaaactctgatacactggctgtactcatatctggtacaaccactttaggacactgtttagctgttatccacaaaagctgaacataaacatatcctatgagccagtaacccaattccttcacatacatgcaccaaaagaacatataagaatgttctgggaagcattgttcatcctagcaaaaaataaaaacaaaatcaaaaactggaaacactacaaccagtagaaagaataaataaattgtagtatgtttaaatatggaatactatacagtaacgaaaacaaatgacctgcagctgcatggatgaatcccacaaacataatgaaagaagcccaacataaaataattctatttgattattgattctattagattaaaaaaaggaaaattaatcaatgatgttaacaaagtcaggacactggttatctccgaagggcatgaaggggtgtaagcacaagaaggttttaggggactaaggaatgttctatttcttgacatttgtggtaatacaatagaaaattcattcagctatacacaaataatttgtctagtactcaatgtatacattatacttccatttttaaaaagtctgaaaaagcaagcctgtgtttacttatgtgatgtattttgatatattgattctgctgcttttaaaaacatgagtttctctgtgtgttctcaagacatttttctatgttgtttgtgtttgggcaaggatgaatggcccttgtgaaaatgcctactctggtttacctatatgataggtaccttatacttataaacccacaaaggcttgcttatccttatactatacatcacagctaggagtatgtctgacagaaaatatggagaaatgatagaaggtaaacaggcatagatgttgctaataaaaatgtcacttttgaacatctcaatccaaagtttgaaaactaaatctaagcctttctaagaggcatggtgatcttctagacctgtgataacaaacgattttgtttgcctgccaactccagtctactgggaatggttgcctggagccttgggttgaaaaagactggatggcatgctaggccagcaacagagaatactgtctatgccatgggtaaaagatggagcatgggtggcacaagggccttgttgactgttacggagtcaacgctttctctcataggatacaaatattttcttaatcattttaaactgtctacagagcctgtaataaagtcatagtttgttataactatttaccagttttattattttaatataattaaatttctaatttattttacatgtaagcatttacaatatttaaatattttatgcttaatataaattatatcattataatatggtttaaatgctttactggtgaaacaaattcaaaagactgcagatggtcttaaaccaaaaaaatggtttaaaaatatttttgactgccattttccttttttgggggtataaactaaaccataaaacttaatattttataagtgtttatttcatcaaaactaatgtgaaaataaactttcccactgcaacactcaagaagactttagctttagtttaacagatgctcatattctaattacaggttaccttacttacagcatcttctctttaggtttcttttgtaaaatcagataattgtactgacacaatttcaaaagttgcaaatgtagtgtgaagagaacctaaatgtggtgcaaagtatcattttattcaatcgcacccagtattattagcattaccaaatggggaaaaaagtgaactgaaatttcacacttctgcctttcacttccacgtgatttctgcatagcccttatcagtacacatacttgacagtagttagatttttaacaatactttatctaatctaaactccccttcatttagacattgaatctcagaattagaaaaagtacagtgatgactggtttcactaaattcatggccccaaatcttaaatgtatactcaacacatttgctaaacccccttctttcccgcccattctctatctgatgaccttgcttcccatttcatttaagaacagacccactcaaacaggaaatctcccatgtttgcccaccatgtttccatctgtaccacacgtagcctcacctctatacggtggatgaaatgtgaacttgctagtggtccattcccatgccctcactttcaaaacatttcctttgcaattatacgcttaccagaatttctctgttgcagtgtaaaatggaaccctttctttgatcctctttctactttcatagcagagtctgctagttgcctactaaatattgattctctcatccttctttctcaaatagaataatccccaattttagtgagcacactgaaatcctgctaagatgttttcagcctctctggcagctaggtgtagccacctgatcaatgacataagcagagatgaggagaaaatctggaaagtctctttaaaatggaaagagtgggtgcttctccttcccttcctccatctacacttgcaatatggctatgagaatgttcttttcaaagtcaccagtttaccaaatccaattatctgcttttatcttagtctctcagcagcattagggagagataatgcctcactcattcttgaaacattctttaatttctagaaatctaccacatcttgatttttatcttacctcacaggtcactccttagattcttcatgctaccttcctgatttccacattttttaatgttccaggcctcttctctttcctcactcttacgtgattactttacacctatggttttaaataccatttatactctgaggacactctgacttccaaattcctgtatctaaagtagatgtttgatatctccacttagatatctaaatgatatctcaaaatatacttagtcaaaacaaaactctcccctacttgtcctgaactgtagtccctcccgtttcagtacacacttgccaccacctagtcggttgctcaatgcaaaaactatggagtcatctttaactccttccttcctctaccatccctacccacatgcatcagcaagtcccgctggctctacctccaaaacacactcattgcttctctccatccccactgccatcaccctggtgcaagccagcatccgagctctccccagacctctgtgatgaccagcatacctccctgctattccctcaatgtctattttctaagcagcagccaaagtaattttttcacagtgtagatctgattatgtctctcctctgcttaaatgcctccagtgatttccactgcctcttaaaatgaaatctaaacttcctgaaccacctgcaaggccccagctgacccgccagacccctctggtttcatctcctggcactcttgccccagatgctgtgcttcagccacactagctttttcccttttccctattttctgagtatttcaagcccaggtctgcttttgaatttttaatgctagttattccttctgtctgaaatgccctttctctgaatcttctcactaccagtccctcctcatcctcattcaaagaccatctaaagtaaaggtagcttccccagtcacttgctctcacctcactttcactatattttctttacagaaagttaagttgctcattatttctccttactacactgtaaactacaatgagagcaggaccttatagattgtttactgctacattcctacagtttggaacagtatctagcaagtactatgtatcccaaaaattatttgttgaatgaatcacaatagaatatcaaaattaaaaccctcttagtctgaaccattattcctatgtttaaaattcttattaataagtctgagaaatatctgaccatcctttttctggtcactgataaggaatctcattcctcctgagggaggcaattctaccttaacaacttggattattcaaaagcccttcctccttctcaaggtgaaatctgactacctgtagcttccgtacatttgtggaggcccctatgttcatgcaggacatatggcttctgtttcacatatgacagtgattcaaacatctgcagatggtgactgtaccttcacctgcatgaacagtccctgtcttttttttttttttgaaatggagttttgctcttgttgcccaggctggagttcaatggcgtgatcactgcaacctccgcctcccaggttcaagcgattcccctgcctctgcctcccaagtagctgggattacaggcatatgccacaacaggcccagctaattttgtatttttagtagagacagggtttctccatgttggtcaggctggtctcgaactcctgacctcccgtgatctgcctgcctcggcctcccaaagtgctgggattacaggtgtgagccaccatgccctgccaacagtcccagtcttcttaacagctcttcacatagactgtggagtatcatagccagaccttcacatgatccaatactgccccggatgtactcgcacacttagctaccaacctgccataaatattcaactctggcccaatctgtcacttctcatcctctggatcaactgatctctttcttagggaacatggcctgatttaagtcaactcttttctccttccagttcatgttcacacacaatcttcaatccatgtatctttcatactacctactgcttgctacttctacaatctcagtacaggacagtcattcctcatcctcaattcctaacactgtttagctttcccaacacaggatgcttatcctcttctttggagaaaggcctcttggcctcctttcttgcataaaggtcctaattttccacatatgtaattagaattataaacttccttaatttttgcacaggtagccagatacacttggggcagaccagtgctatttctaaccagcagcaagggagccattaaaaaaaaaaaagaaaaggaaagaggctcttctgtggccaccatcagaacagatctgatgccagaggagcaaagcagagccaacgccggtggcctgtgacaaactgcagcagttctcaatgtaccattcctacagtccctgctgtggacaacgtggtgcctggcactgtgcacttccttgttcttccagaaataggtaaaaaacccagaaatcaccccaaatcagaataagggttattttataccactgtgcacagcagcacctttttagagtctagttttattctctttgctcctaaaacacactagcatctcatttaaataattcaggtagaggaacagctgttgaggagttaatgattagataaagaaacagagtatggtcatttgaaaacactatttctgcaatgtgttaacattctgttaaaaagaatagccttgtaaggaactaggctgaagaataaaactatattaacatactccgaaggatgaaagagttcaggtaatgccccgagggccaaaccctgagagcaagactagaatcacccaaggtatctgattaaccataatttacaaacaaaaaaaagtaaaaaaaaataaaaaaataaaaacctatccactcaaatctgctataatgatttttttaatacatatcctgacgatgaatacttccgaatgaagtgccacactgcatcagtctactggtaatctatctctgacaagtatagcaaagaataatttggccgggcgcggtggctcacgcctgtaatcccagcactttaggaggctgaggcgggaggatcacgaagtcaggagatcgagaccatcctggctaacacggtgaaaccccgtctctactaaaaatacaaaaaattagccgggcgtggtggcgggcgcctgtagtcccagctactggggaggctgaggcaggagaatggtgtgaacctgggaggcggagcttgcagtgagccaagatcgtaccactgcactccagcctgggcgacagagtgaggctgtctctaaaaaaaaaaaagaatatgtggggaatgcaggtctgattttctaaaataccttcctcaatagattaaaacgtcctctccttagttcctcttgctccttaataaggtaccacatacttgcccatcataagattaacctaatccatatccagtcagattttatttttaataaactttatgttccttaagcccttggtagtgctacctggttccaaacctatgagactgagtcatcaggtctcatcatctcatctagaaccagatagctttaaagcagatataagaatccattatccttttaaatctttattttatttaatgaaataatgtattatgtgcctggccctgacttcctatagaaaaatgcagtaagtgttatctcaaatataattctcttgcattcattctaaagagttcgagccctttaaaacctgttgttagaggaatgctcctccctctctcaatcagcagagttgtccttttatgaacctccaccaagttcagttaagagtggatacaaatagtgaagtccatttaaaactcaactcacaacactgtgtgatcttctggatgttagaagagatcctctgggccaactgggcggggtcaccaccaactcctggagtgtaagacatggttgatgttcttattcgctaatttcatcagatgctgtgcagttttctaagcagtcacctaaataatataaaagtcacacagatatattttttaagttactggcttacattttccaaattaacaatctgtgaagttacaaggacaaacttgattaatctaatagagttgaaatctggcaaagtgacacatcaaatagcaaaactctcatgtctactaaaaaaaaaaaaactggacttcaaaggacagagtcatgttaaacacatcaaacaattaaaataaggttcaaattgcatatttcctttgaaaacgtctttgatctcttcaagaaaaattattaaatcccttacctgtatataattttagttgtttacatattttttccttaactaaactccaaacaattataaggcagggcccacatgcttatttatctttctccaatatttaaaacaactcttagcacaaacaggcatttaaatatttattaaatggaacacagacttcaggctatccccagaaatttcactgtattaggttgtgcaaaagtaattgcagtttttaccattacttttaattgtggtttttgccattaaaagtaatggtaaaaatggcaattacttttgtaccaaccttaatatctaatttaacacacacacaggacctgctcaggaatgtatgattaatagggctctaattttaatggaaaaggttaaatctgaaatagcagagccaactactgcgaagcaaatgtcatataaaatgtttatcaaaccttcctgacagaggaaggagaacgaatgactctcccctttcagcagccagcatctcagaatagaagagacactgagatactgccacaggaggcaggtgagatgacattctctacctcttcaatccacaccactccaatcagggtttggaaagaaggttgaaaaggaatgtccctgcatacagaactgcgcacagcaaagaatttcaactaccgccaccccatcttttccatgaatatgcactggaatactgcaaaattgttggtggtcaatttgtaagctagctctctactaagagcctggtacatgcccagcattaaactaagcacctgggagatgcaaacaaaacaaaacacactgacacagtatctgctcaaatcaagtttgtcatttaggaggaaggataaagttaataatgcaaaccaacaaaaaaccccacaaatccataaaagatcacgtgctaggctaaaatgagaagggctacaaaaagaaaaaatgaccatcatccttgtctggaaagaatttatgaaatagaaacataggatttggatgcttggttatgaccagtatgcagaacaacaaaggcaaggacgtgaaggctggggtggagagacccagagcacgtggaaaggccacatgcagtatggtatttacaaaaggaagggaaggttcctggccaaccctggatcagatgattcacagctgggacaaggggaaaacaacataaagggaaagagaggaatggcctaacatttctcgcacatctgcgacacaaaaagtatttcacagactaattttttcacaacctccttcaattaagtggcattattcttgttttaatgatgagcaaacagcgggcttattatgattaagtaatggtaacccaacccacccacaggtggaggtgagattcagtcccagggttctgatgccaaggctatccatgcttgctaccacatagaactaatgccacagaagatttctggtagagaagaagccacagtgaagtatgtgtctttgctctaagggacagtgttggcaggaagtacaacagctgaactgttgagaccattagaacagtactggttctatgcctggaactctggtgcactttgaatgtgcctggccacgctgaaagtcctggtggcttttagatattctccaacttccctctcaggtacagctgatctattctgggctctctgggtctcaccaaatcctagagatggatccaaaagcaatttcattaaagggtaaattcaaacctaaagtcagacagctggaccactacagtggggagacaggaataaacttccttccaggtagccttggacttgggcccagacagaacaagagtagacatggggattcaatgacaccaacaccatccggaacatccttgaaaccatgcaattttaaatgcatctccaagtcacttaaaaaaaaaaaaaaaaaaaaaaaaacacaggttttgaatagccaaagcaattttaagaaaaagaacaaagctggaggcatctcattgcctgacctcaaattatactaaaagggtatagtaactaaaacagcatgatattcatataaaaacagacacatagaacaatggaatggaatagagaagtcagaagtaaagtcacatatctacagtcaattgatctttttgacaaagttgacaaaaacatacactgaggaaaggacgcccttttcaatacatggtgctgggaaaattggatcgccccatgcggaagagtgaaactggacccttatctgtcaacatataaaaaaaaaaatcgactcaagatggattaaagacttaaaagtaatacctaaaacgattaaaatactaaaagaaaatatagggaaaactcttctggacattggtttaggaaaagaatttatgactaagacctcaaaagcacaggcaacaagacaaaaaacagacaaaatgagatttaattaaactaaaaagcttttgcacagcaaaagaaataataaacagaatgaacagacaacctgcagaatgggagaaaaatatctgcaaactacacatccaacgagattaatatccagaatttacaagaaactcaaacaactcaacaaaaaaccccacaaataaccccattaaaaagggggcaaagcacatgaatagacatttttcaaaagaagacatacaaatggccaagaagcacatgaaaaatgtttaacatcagtaagcaccagataaatgcaaattaataccacaatgagacatcatctcacaacagtcagaatggctattaaaaattcatccacaaacacatcttgaacggaaaaaaaagaaaaaaagtcaaacaagtacagatgttggcaagaatgcagagaaacaggaacacacacactgttggtgagactgtaaagtagtacaacctctacagaaaacagcatggcaagtcatcaaagaactaaaaatagaattaatatttgatccagtaacctcgttactgggtatctacccaaaagaaaaaaaaaaccattataccaaaaagataatctgcactcatatgtctattgtagcaatattcacaagaacaaagatttggaattaacctaagtgcccatcaagtgtctattaacattcctgaatggataaagaaaatgtagtgtatataaatgcaatggaatactattcaaccttaaaaaagactgaagttatgtctttcacagcaacacagatgaactggaggccattatcttaagtgaaatgactcagaaaaaagtcaaatgctgcatgttctcacttgtaagtggaacctaaataatgtgtacacatggacagagagtggaataagaagacattggagactcaaaaggatgggagggtgagggatgagaaattacttaatgcgtacaatgtacattattcaggtgatgattacactaaaagcccagacttcacgctatgcaatataaccatgtaacaaaactgcatgtgcaccccttaaatttatataaataaaatggctttattgagatataatttattgagatatggcaatacaatacacctacttgaagtacacaagccaatggtttttaatatatttacaacattgtacaatcatcacttttagaacatttctattacgctaaaaggaaagtttgtaatcattagcaatcgctctccatttctccccaacctcactggccaaaggtgactactaatctactttgtatctttatagctttgctattctggacatttcataggaatggaatcatacaatgtgttcttcgagactagcttctttctcttagtatgcttccaaagtccatctgtgctgtatcatatatcagtccttcattccttcattattgccaaataatattccttcattattgccaaataatattccaaggtatggagaaagacaattttctcttggttcaatgacatcttcctttctcctttccctctatcaagtagatctctggaaaaactggcttacaagccaaaacaaacacattgaatgaaaaaatgttcagtttgttattcatgtaatctctggggatgctcctccatatacatggttccattttaatctatacctgaatgagtcgcacatccatgtctccagctcgtacccttggctttctctcgtgtctacatgtctgtgaagctacaagaactcagccattgcctgtgcggcacaccatggaagtagcaactggaaatttctactttgggcaagacacttagcatttgggcccactgccagaatcaaaatgagataatgcacatccagagaacaaatgcttttccaccctacacagaggaaagttatgatctgttcttgcagctgcaggaccagcatcagcacaagaccaagagaaactcatcacctgtctcaaaaccatgcaagcacacctgaggcctactctctctcccataaagagttccatcaagtcaaggacagtattctacagcattttccttacccttaaaactcacaccagtgtagcccaagtcttctcactgttttctttcaaggccaccttttttcctctctggaaaatcaatcacttagtcacaaacacaatcaattttcttcatccctttcctcaagctactaaatgtgagaaagttcctgctggtgagacaattggcaagtggcttcattcacccaaagaggtgctacttagattgactggaattatgagttttgttttactttttctttgtttggcgttgttgttgtttgagacaggagcacccaggctggagtgcagtggtgtgattacgactcactgcagccctgacttccaggctcaggcaatcctcccatctcagcatcccgagtagctgggtccacaggcacctgccaccacatcccactaattttttgatttttttatagagatgggggtctcactttgttgcccagactggtcttgaactcctgggctcatgcgatcctccagtctcagcctcccaaagtgctgggattacaggtttgagccactgtatctagccaggaatcatgtgtgaagaatgaaaagcaatttgcaaaagatagagaagaaagatgtgtaaaataaaacaaagttaacaatggccaacactcatccaggacttacatttcctaagcattgtgcttatgacttttaaatttattttctcagttaattcttataagcctatcatgtgggtataattgctaatgtgatttttttacatgaagaaactgaggcatatcattatgcctcattatcattataagcaaaggagcaaatatttgaaaataaccacagagccgacattttttaaacactaagccatactgcttccttgtataacaaaattgagggcaggtgaactcagttagaaaaaccaaatttgggctgggcgcggtggctcacgcctgtaatcccggaactttggaaggccaagacaggcagatgacaaggtcaagagattgagaccatcctggccaacatggtgaaatctcatctctactaaaaaaattaactgggtgtggtggcatgcgcctgtagtgccagctactcaggaggctgaggcaggacaatcgcttgaacccaggaggcggaggttgcagtgagccaagatcacgccactgcactccagcccggcgacagagcgagactcgtctcaaaataacataacataacataacataacataacataacataacataacataacataacataacataaaataaaaaaagacaaaagaaaaaccaaatttaccacttttctgcatgccccatatgaagttttgctattcccactcctaagatgaaggaatatgtttgggataactacatgagttgatcaaggtaacacagaggaatagcttactccttttctctattattctgctaataagtggtatctaaaaggcaacaacagttggctcttttgataatgagacacacaaaggaaaggaaccaaatggttgtctttaaaaaatatatatacaagcatagacagacaggataggtaactacaaattgattaaaagcttatgatctctgcatataggctaaatggatgctgagttattcagatgtctgctttccacatcagtctccattacctagcccagagctgctacgcactaaagtactcttgttgaatacttttgaaagcccactcagaattcctatttaattgctcagaataataattatataattcattacctagacctgtactaacagactagccactaactaaatgggctgttaaaattatagtggttactagaagcagagaaggatggcgggaaggggatagccaaaggttggttaactaacaccaaaatacagctaggtaggaggaatgaagtctagtgttctatacccctaaaaggtgactacaattaattacaatttattgcatattttcaaatacttagaagaaagaatgaattgtgaatgctcttaacacaaagaaatgttaaatgtttgaggtaatggatatgctaattaccctgatttgatcattacacattgtacacatctactgatgtatcacatgtatccacaaatatgtaaatcattatctgtcgattaaaataataaaagcaaaaaaatcttattacaggttattttaagctgctaacaagataactgattgcagtaagaaactacacttttactctacatttcattttttcatgtgacaatttacaccattttatattgtgtatcacttaaattacattgtagctctcgtttttaaaaaattaaaattaattaaaattaagttaaatgaaaaaaatcagttcctcagtcacactagacacctttcaaatgttcaaaaattctgtgtggctagtggccagcagcttggacagctcattcatagaccacttccattatcacagaaagatctattgcacagtgctaatctccacattgcaataatcatctttctatgaagatatacaaacactataaagagaaaaacaggaagggagaatcaaagtgcaacactcagatgagagtcttctcaagacggcttctaaagaacacaaaggaatgaacaaaaggaatgttaaaatttaatcttgaagtgtcaaacactactcccagttaaaatccgatatactgtagaatccttaagatttccatttagcatatatctcatgctctataaatctaccctgggcaaagaagtagtcaatttcactttcttaatcattagcatcagcataaacaactggacttctctataccctctaccccaagtaagttctgaggggtggggggtgagcatttttttgtctgttttgtggactgcactattctcactgcctggctacatcacaagtgcttaacaaacatttgtagaatgaatgaatgtacccacctcctaagaacacacacccagcgtgagggtaaatattaccatttccaaaacataaaattccagtgccttctttcagataccgaaggtcccaggcttcttgctgccttgggcctttgctgggtgccatttcctatttctagaaggctcttcccatgatctccacgtgactggctccttctccccagcaaggcctcatcacatgctagagaaacctttgtgaccactctgatatgaaagtgagaactcaccactggtcactctttgtcaatctaacttactgcttcacaatactcaaaagtcgaattaatcactgtttattatttatccctacacctctggaatacaaacaggagctacttctggaatataaacaggagagagatgaccttgtcatcctgtgtaatctacagtgcctggtgcatagtaaatgctcaaggaatgtgagggtgctctgtctacataagtatcctctgcaaaaactacattaactgtattctttggccttagctctttcatcactgaccttttgtactacttggttttagttcacaataccgaggattgtttttttcatactttcacacatgaaacttgcaaattaaatggaatcacagcaaacttcactcagacttactgtgaatattttctataatttacttttcaatcatcagcacttaaagtttggggtcataaccaaaataaggattgattttgttatcaagagcaacataagtaacatatctgaggaaaaattatgatgttaatcagttaatatggtatcatattaacctctacagaaactgtgaagttaagagcataattcttaactagtcacgagtctgaggccaacttctcaaagtagcctataaggcctgtccacaacacaaaacacagtttaacaccgttatcagcctctgcccaggtgtgctcagagaacctgcagaagaaatgtccacttccaacattattaaatagcacagcatttcataattactttcttttcttccagattctgggcaagttttatatattatatataattatagtcagaatacaacgatctgaggtaaacaaaaattaacgtatacagataagagccaaacaaatgtaagaaatttgtgggaaaaaacacacagcatttgatcagaaatgcaactttttttctttgtctgaatttaaagaaagtaactagaaaacaaggtggaggaaatactagaaatattttatgtacgtttaaaggtttttatgtaaattaattaaaggtgtatactcaaagaatgtcaaagtatgttaaagtcatcaagccaaattaaaaaaacaatactacgatcctctgaataaataaacatacacggttcgcctgctacagccatacatttttcagttcctctatattcgggaagtttagtgtgtttttcaatccgtgagttgaaaagaggaagaggtcatttggtcgtgtctggattcctgagctgggccccagccggctctggcgccctccccggggtgcgctccgccagccgtgcgcctccggagctctgcccaggggaccgcggcgggtgcgtggctgggtaggcccacctgaccacagccgcgcgcacccggaatgcggaacgcgccgcgcccttgcacccggccggggggcgtggggagccgcaggcgctccgggagctggggcagtcccgcccttcctagcctcccgagtgcctgctgcagagcgcagggcggcggccacctgaccacgcgcacaaacaagaaggcgcagcagccgcaggggcaccgcgcctccctgtcgcccggccagggagccccctccccagggtcctcttacctggacctccacggctccctcctacacctccgaccgccgtcacccacctaccccggagccctcagctgcaattctcagctgatgggcggtggcgtggggacgcccagtgcgcatgcccgcagcacaactcaggaagaaggcggggttcaccccttttctattggcccgcggggctgagtgacagcggccctcaccgcccctccggttccaagctaaggaatgggggtatcagcaaaattgcaagggagctgttctttgaagcctgacgtagagatggtgaacgcctcttagcctgcgtgcaaaaaaggacagaatggaggacagttgtcttctttatctggtgaagccagccttcttgcacgcgggtcttcaccccgccccattagctcttgcctgtcttgtttgctaacctttaactgcagtagatcgcgttgacagctctatcgaaaaatgcaaaggcgagtacacaatcctagcaggaacaatgaaggaataagtgaagagtcatctctgggtgctcacttgtaaacaagttttcctagtacatacaagtcattctaagcattcctgaaaagcagggcgtagttttcacagggtttaaaacaagcagagacagttccaatgataaatatgcaaatatattgtaattgttagatgaaaagcatcaattgctacaaatgaaagaaagccctctccaaattaattagaagatagattggcttagcctttgcctatattaaggcaacactattttctaaaatgattacccggataggtgatatcaaaagtccagacgcacttaggtggaaaaaaacaaaacccaggatagaattctgattggaactcaccaacactaagtgtggaatgttgtctgcttaagagagatggacagagaaagaataaccctgaaaacgagtaacccacaagataggaaataaaccaggaaaaggtaaactagagaatgaaggaaaaaaggagggaattgtccatgatgtcacctgttacacaaagttcaagtaaataaagaactgaaagtagtgcattgtacttgagaattaggaagtggctggtgaacgtaggaagaaacatttcaatcattgaaggaacacatgaaaggatcttacatccatgtgaggtttagtgcactttccaaatacccattcatattacctttgatagaactctgggctccggggagggaaggtacaatgcactacagaagaacctgagattaagtggcctcttcaagttaccctgatagttactgactatgctgggcccaaaacttagctgtctgagccctcatcttgggctcattccaattccttgttttaaaatatgttatgagtggattccttccaggtcttttgaaaacttagaataagatttcatcctttggtattcaaatgggaaaaaaaagaattatagtctagacaaacttgcaaaatttagaagtattaagataaatgaattactaagagttcctgacacagtattccatctgtgaatctggctgctaccaagttaaattcagccaggtgtcttgaaagtggtagggctttaaaagtctcctaatttgatgagtgataatgtcacatctcccaaaataaatcatttccatgtgcagaagttacctatgactgaaagcttgtaatttggattttcagaaatagtaatttgcgagatttgggccttcttggagagattttgaaggaaaccagaagttgttgagtggggaatgttatctgcacacttgtggtgtccttattaatataaataccataaatacctcctatgtaacatctctcatgtaggatggagaactgtccactgctgtatctccagtgtctgggatagcaattccagggaatagaaggagataattgctggttcatttaatagttactgaactaaaaatattttttacatgaccactatgtgatcttctgggaaagccaaagaagtaaaagacgcataaaggtaaatagagcaaacagggacttattggtaagtgagaaggacaagttgacttatgaaggtttgtttttatttataatacagtgggaaaaccacaactggtttaaaaaatctatgctagattaaaaggaagcttaaattaatacttaataaacaagagttagttcagttgtgccttattgttaagcaccttccatgtctctctacagtctacttgttttctgtttaagatcacacaagtgcctagtcatatatcaagcacagaattgattttgccctagcttttgaacatggaggtaataaacagatatcccgtggaaatcttacatgggccattatagcatgatgaccggtatatttgtttctaattttacctcctgatgactggtattttcgtttctaattttacctcctaagtgttgttcatatgtgccctcttctctctgtccctcacggttgacatcctgatccactgcaatagcctccttgttggatcttctatctccaggtcttctcaactttattattgtcaaagccaccactgaatatttgaagctctaatctgagaactttgctccaggcttcatgccatttccatgattgcagcattccctgaactgtatttcttaagaaaaaaaaccaaaataattagattggggagagctggggaattgtgtgggttgaaataaggaatcagggaattggtctacaaagaaatgtttgggaaacatattatattgcattcttgaagattcacagagcatatttgtaaattaaagacgctgagaagtggttcaggaaagaaacaagtaaaaatttcttttacccagtattttatgagtgtatttgatggtggaacttgcctgtaaaacttttaaatatgcataatggaaaacactgctctcaaaatcaagtccaagccccctgcatatacacagggtgaccatatatttagtttgctaggacagccctagtttatgcttgttgtcctggccgcctgtcttctgagcatgccctttcattctcaaacgtgcttcagttcagatgatgcatcatatggtccctatacatataaggaccacatggtctgatcctgcctttccaagcatcaaaatttatgcttggaatatgttggcttaaataactcctctttctctgtctgctctcccctccatcccagcagctagctccccagtcacaaaccaggggttttcttatttctgtgcttcgctcacgtagttcccattagctagaaaacattttttcttctcccccatgttttaaacgattctttattttggaataattttagatttatagaagagctgcaaagatagtacagcactcctgtatatacctcacccaggttcccctaatgtttccttaatgttaacatcttacataaccatggtccacttgtcaaaactaagaaatcagcattggtatagcagtaccaactaaattagcttgtattctccctgctccagctctagaatcagtcattttactattaagcacttcttctttttattggaaaaagctatttagaaatcaaaggccaggaccaccaggcacagtagcatggctcacacctgtaaacccagcactttggaaggcgaaggcaggcagatcatttgagcccagaagttcgaggccagcctaggcaatggggcaaaaccctgttgtgatggttaatactgagtgtcaacttgattggattgaaggatgcaaagtattgatcttgggtgtgtctgtgaagatgtcgccaacagagattaacatttgagtcagtgggctggagaacacaggcccacccttaatctggtgggcaccatctaatcagctgccagcaaatataaagcaggcagaaaaatgtgaaaaggctagactagcctagcctcccaccctatatctttctcccgtgctgaacgcttcctgcccctgagcatccaagttcttcagttttggaactcggactggctctccttgctccttagcctgcagacagcctatgggaccttgtgatcatgtgagttcatacttaataaactcatatatatatatatatatatatatatatatatatatatatatatatatatgtattccattaattctgttccactagagaaccttggctattacacccatctctacaaaaattagctgggtgtggtgatgtgcacagtagctatagtcccagctactcaggaggctgaggtgggaggattgcctgagcccaagaggtcaaggctgcagtgagccaagatcatgccactgcactgcagtgtggacaacagagtgagaccctgtcccccaccctaccaaaaagaagaaaagaaaagaaatcaagatcaaggcactaaccttctcattgttactagggtgtcagtgcttctacgctcccctcaatggacagagctaggaaataaatttatatatactaattcatgtatgtaggatatttactccaggcttcatgccatccccatgttggctgcatgccccaaaatatatttggtaaaaataaaagtgcttggactgggcagaggtggggtttgtgtgagttggggtaaggaatcagggaattgatccatagagaaatgtatacagtatacattatatgcagtataagccttgtataaagtatgtctataaatttaattttacaagaaactgccaagttgttttccagttgttttacatatccatagctatatcagattttatctatatatataaacacgagttcatctaggcattcccaattctaatccaacattataggggtcattctagccttcccttgtcctaatttttagcttctttcgctagaagtgagaaacctagcttccattatctaccatttatgttcttatttctataatgtaaaaaattaggttggtgcaaaggtaattgtggtttttgccattaaaccgcaattacctttgcaccaacctaatagcttcagaattgctaactcctactctgtgtgagaaaaaaatctttagtgcagtgtttatgtacaattctttttgtctttagccttataatattgagtcaaaacaatgttttctaaaaatcaccaaggtcggctctttacccatccccttcagtgaaattaggttatgttgactttgcagttaaattcagttgtcatagatctgcattttatcctatgatccacaaatatactgattgattttttaaatttgtataaagctcattgtttgtggtatatagttctgtggatttttgacagatatatagagtaatgtatccataactccaataccatagagaacagttctaccatactgaaaattccctttcacaacaacccttattcaacccatccccctcctcccacccttggcaaccacttatgttttctatcaccagagttttgccttttccagaatgtcctataaattcaatcatacaatatataaccttttgggtctgatttctttcacttagcagaatgcatttaagatacatccacattgttgtataaatctatagtttgtttttttttgtggctgaataatattccattgtttggatataacacagcttatttatccattcacctgttggttgtttccaatttttggcaattatgaataaaacttctataaatacttaaatacagattttggtaaaaatagaagttttcaatcatttgagtgaatatctagaagtaggtctgttggactgtataagtgtatatttattcatttatttttgctttaaatattgctccgggggaggggccaccacacgtctactcaatgaagagaaatgtttttacaatttacaggtattttttttacacctattatggcatgaattcataggaaataagttctagcagcctccttcttattggttctcacacagtgtgcttctctggatggagcaggctgctgctttaattgaactcaggtgactttctccttgagatccttttctgatcgttttccttcacgtgtttgaggaagctgtctcggcacttagagtacttaatatgctcaatatgcacatcaattatcttggcaagaatcatgccgttaacttgtttgtttacaacagtgccaacagtatgctgggttacattgtagactcttccagtttttccatggtgatagttgtggggcattcatttttgaacagcacccaacctcttgatgactacggtataacctttcttgtagattcgcatgtatgtgaccaaaggaacaactccatgttttctaaaaggcctagagaacatgtatcaggtgcctctcctctttccctttgtgttaatcattttggcaaattactggaagatggcaattctggctctacatttaattttacaaaatacttccaaattgttttccaaggtggctgtatcattttgcattcccatcagcaatgattgaggatttctgttactctacttctttgtcactttttgatattgttgaattgaaaaacatttttttttcattctcatgggtgtgtagtggcatgtcattgtgattttatgtatgcttatttgaaatccatctgtcttctttagtgaaatgttaattcaaatcttttgcctgctttttattgggttgtcttcccactgttgagttttaagaattatttttgtattctggtactttatcaaatatatcatttacatgtattttctcctagtctgtagctctgtagcttatcttctcattctcttcttttaaaattttttaaattttctttcagaaaagatctgggatctggctatgttgcccagactagaatgcaggggctatacataggcctgattgttggacatacaactttttaaacttctgggctcaagcaatcctttcttctcagcctcccaagtagctagaactatatgcacatgccaccacacccagctcattctcttaatggtgtctttcatggagaaataagtctttaattttgataaattttaggttgccatatttttgttttataaattatgcctttagtgattaatttaaaagctcatcaccaaacccaaagttatacaaatttttcctatattttattctcaaaggtttatggttttacatttcacatacaggtttacaattcattttgagttaatttttgtagaatgtatcaggtatctgttaaggttcatttcatttgtttttttgcatatgaatgtccaattatttcagtacctttgttgaaaagtctatcttttctccattgaattgcctttgcatttttgccaaaactcagttgactatgtttctgtgaacctctctctatttttcatattctcttctattaatctatgcatatattttctccgacatcatgctgtcttgattactgaagctctagagtaagttttgaaattggataatatgagtcctctgacttttttgttttccggaattgtttgattatttcagtttcttggcttttctgtagaaattttagaagcagctagtcaatatctacaaaatcatgctggaatttgattgggattgttttgactttacagaacacattgggaagaactgacatcttaatattgagattttcaattcataaacatagtatatctccacatctatttggattttcttatattgtttttcatcagtgttttgtaacttacaatatacagattctgcacatattttgtgagtcatacataatttattcatttgtttgggtactattataatgtatttttaaattttaatttttacttcttcattgctgaaatatggaaatattattggtttttgtgtatcatccatgtattctgtgaccttactaaaggaatgtattagttttatgagcttgtgtattatttggaactttctacatagacggttgttctgtgaaagggtatatataaaaagtgacccccaaatgccaaagaagccaagaaaccaaagaaggaggcagacaaatctagttcattggtattgggtgacttattagagggaacttacagacagcagcatggtcttgggtggccacaagacacatagttctctgcactgcaaaccctgagacccagggcatgtatcttgagggaaaagtatatgtactctggaaggaatgtgcaggtggctatgagcatcagggcctaagatttctgtaacagcatcaagggaggttttggaggaaaacttacaataaataggtatttctaaataaaaagtaatacatcagcaagacattttggcggcattcctggacttggggttagtcagaagttacgtggcagattggcatttaaaataaaatcactattttccccacaaaaaatataatctgtgaatatagttttatttttttcttattctgtatgcattttatttgtttttcttgctctgtcaaactaattagaacttccattatgacactgaatggtactaacgagagaggacatttgtgctgggtttctgcttaggaggaaagcattcagtttctcaccactaagcaggatgaacagcatgaagtttgctgtaggttttttaagatttcctttcctaggttaaggatgttttctcctacttctagtttgctgagaattttaatcattaattaatgttaagttttgtcaaatgctttttctccacctattgatgacatacttttactttttagtctgttaatgtggtgaatagatagttattgattttcaaatattgagccagccttgcgttgctaggattaatcccacttggtggtgatatattattcttattatatattgctggattttatttgctaatatattgttgataatgcttgtatttgtatttttgagggctattgtctggagtttttgcttgtctttttcttataatgtttttgcctggtttcagcatcatgacaatgctgatctcatataaatggaatgtgtcccctccttttctattttctgaaaaagattttgtaggattggctttattttgtccttaaatatcaggaggattcaccagtgaaaccatatgggccttactttatatgtttttaaagacttttaactatacagcacattcattacatataggaccattcagttgatctatctcttcttgagtgagttttggtagtttgtttcttttaagaggtttgtccatttcatctaagttgttgaatttatatgtacagggttgtttgtagcattccccattctctctttgatgtgtcaggatcagtagtaatattctttcttctatttctgatactgtaatttgcatcttctctctttttatctcttagcctggaaacaggtttattaatactatcgatttttttaaacttttggttccattgattttttttctattattttttggttttcaattttacttagttttgtcctaatatttatttccttccttctacttgctttaagtttaatttgctccttttttctcttgtttcttaagctggaagcttaagttactgacttgagatctttcttcttttcttatgtaagcatttactgctatatattttcatttaagtactgatttagctgcgtcacacacattttgatatgttggaatttttactttcatttcattcaaactattttttaaataacccttaagacaccctcttgacccatggtgatttttagaaatgtattgtttaattttccaaatatttgaggtgtttaagataattttattttattaatatttggtatatttttatggtcagaaaacatactttgtatgatttatattcttttaaatttgttaagttttgtttgctggcccagaatatgatcaatgagtatttcatgtacactacaaaagaaagagtaatattgctgttgggtggaatattttataagtgtaaattagttcaagttagttggtagtgtttgggggattttgctgatattctccctacttatttcatcaattactaagagaggagggttgaagtctccaactagaactgtaaatttctctactttttctttcatatctttcaggattttccctatgtgttttgaagttctgttgtt

SEQ ID NO: 360 - DNA, 214275 bp, Homo sapiens
gatgcaccaccatgcttggctaattttgtatttttagtacagatggggtttcactatgttggccaggcaggtctcgaactcctgacctcaaatgattcagccgcctaggcctcccaaagtgctgggtttacaggcatgggccactgtacccagccagaattccaaggttttcacagcgattctcagggcttcaaattcagagacttaagagtgtggatgagaagaagcacctgaacaatttcaaacaccaaatgtcccttcgttaaagactgtctaagcagtctttttctctctcccctagaaggttgggcttctattttgagtttgatattatattgaattcattttaatgagattcaaacagcctgcattaatatagagcccaatgtgtttttccacttaattctatatttctctcctgattgatttcctgccttgcagccatggctatctgtgacaaagggactctgactctttgagcttagtatctgataattgtgattacataatacactaaagagtagctaaccgtagcatttaagccaataataaaatacactgttgtccttctaaagattttgctttccaagattgcaaaatataaatacttgattaatgtttctgttgtaaaagatgatcagaaaatagggatttggaagcgtcttcctttgtgagctctccacatgtgggatatttggaactttataccagcagatgccctgagagggcttttctctaaaaataaacgtctcttgaattcaagtctactgatttatttgattttaacttactttctccaaaaaaaagaccctacatttattcacatggctctttctagaaaatatttcattcagctggcacagtggctcacacctgcaatcctagcactttgggagactgaggtgggcggatcacttgaggtcagaagttagagaccagcctggccaacacggcaaaaccccttctctactaaaaatacaaaatttaggctggcgtcgtggcgcatgcctgtagtcccagctacttgggaggttgaggcaggagaatcgcttgaaccctggaggcggaggttgcagtgagcccatagcaccactgcactccagcctgggcttgagcaactttgtctctaaacaaacaacaaaaattatgattgacttcatgcttaaatgctaaagtatactttcctaagtccattgagatactttataaattgtgtctcagatatattttattttggaaaagcattttttttaaaattttgtcaataaaggagactatgaaaaatgaagtatttcccctaggaaaataagcaacttaaattcatatcctacgtgatattggcagggcaataaaagtggtaggtagagtaccatatcaaaattttttaacttatttcggcaaatcatttacttaaggggtctcctctgtcgcccaggctggagtgcagtggcgccatctaggcgcacttgcaacctccacctcccgggtgcaagtgattctcctgcctcagcctccctagagctgggattacaggcacgcccaactaaattttttttgtatttttagtagagacggggtttcaccgtgttggccagcgtggtccccatcttctgaccttgtgatccacccatctcggcctccctaagtgctaggattacaggcgtgagccaccgcgcccagcaacaaatcatttaaaaaatatttctgagaaaaaaaattaaagctgtagatagtgttttttaaaaatgctgtaaccatttatatttaccctttggctactgtttttttgtttgtttgttttgttttgttttttgagacggagtctcgatctgtcgcccagagcctcccgggttcacaccattctcctgcctcagcctcccgagtagctgggactacaggtgcccgccaccacgcccggctaattttttgtatttttagtagagaaggggtttcaccgtgttagccaggatggtctccatctcctgacctcgtgatccgcccgccggggcctccgaaagtgctgggattacaggcgtgagccaccaagcccgtccccttttggctacttttaaatctaatttctaatcccataattgagttcacagtggtttaaacagatatcaaacatattttaggtattagaactcatgatattgtcctgagaaagtaatggaggccaacttaaattcccttgggattaattaaaggagtcagaaatgattaagactgccatggggatatttgccgtatttttaaaaatcaaatacatgtagctagtaggccctgcaaaacatgtagaggcttagagaaatgaaaggcaaccaaggccccaatgtagggatctcaagggtaagtaggtggactttcctgtctcgatgctatgtaatatcacctaagcacctgctgggtccaagcattccagtttcactgggctggtgtggtgcagaaaggagaccccgcccattgaatgcaagacacagatagttataggaaaattcttctttagcgttcacttgtgtctctcatttcagagcaaaaacggggagttatttctacaatttgcagaaatctctcccttttactgtataatcatgcaaataacatgaggacagttaggctgtagtaaagtaatagagacttttgatgatggttttacccccttaaaatttttataaacaggaattagagggtttaataaaggacacattcattagtgagataaactctgaaggtaggagttcaatttcaggctcggcttcttgccagatgtttgaccttaagtaacgcatttaatatttctaaacctcagttctcttgtctgtaaaatacagatcctattaagaccttccttattggagtattgtgaatgttaatgaaattagctggggtaaatacattaaaaagtctcattcacagtgacagttccaaaattattagctattattatttttattatggtaaaaatttggaagaagaaacagttattttggggggatatgcctgggaataaagagtcaagaacaacaaacaatatctttataatccattaagagctatgccaatgtttgcaaggtttccttcagcaggagaacattaatacacttaaaaaataaaatccaaaaagttcttttagagaatagatgttttagattaattctgtttgttttcaaaataaataagaaccatggtaatgaacctcaaaggtgtattgtcttagagtttctggctttaatattgtaactgatgacattaaaggcaattaatccattaattaaaaatctgcatttatgcaaaggagaggggaaataaactacttcaactagcttctgacatatttacacttgaaatcaaagcttttgttaagttaaactagaaagagccgtttaacataagaaagagttaacactcgcttaggggtgcccttttttttaagtttgttggaaaatacttgacaaatctgtctgtaaaagcaactgcaaaaatattgtcactgcccttttgacagtctgaaaaaatcatggttgtcaaaataataagcaaactacattttataactatcaagagaaaaatatcagttttctactttataaagttgttttttagcatatcctagtgtgtgatgactgactaccatacagataggttgataatgtcaatacgtaggatatcttcctaaaagaatctaacacaatcccaccttccatttagcttgcagaaatacatcggcctactgagtaagcaaccaggcattgcggctgacttaaagaacatctttatgtccatggaaatgaacattttttaaacatctgtaagccctggtttcttggtaaagacagtaatagtagtaagtttgagtggccagctgttttccatatgttactcagaaacttttacacaagtacttacttcctggtagtgttgagtgagtgctagacctacattaccttccttaaaatgagaaaggaaagtatgtcaagggactgcattctgcttctgaagagctatgtacttagcaagtagtttactcagaagtaagagcctacagcaaactgatttcaaaagtcacttaatctttttagacaggctgaacatgtcgttccagaagcagcacgtgtaaattctcccaagacaagcaacccactgacactggaaacttgtgttgaagacctatcatttaaatgcgttatgctaaattctagagagaaaggaagcaaagatgataagatacggtttctgcccccaaagagttttaaggttttaaagtaaattgcctttgaggcctaaaagaaactttcccctctcctccttttcttgcactgacagtttttcgtttgtgttttttaacagtatttcttttgccctttgtatccatctttctattattttctgccgtgttggttcaatgattatgattttgctgctaaagtttttatttcttcaactcgtctgagacttagctttacattaaaacatttcaaataaatgtcagaaaagcagtgttaactttttaagacttgatcccggttgaggggcaacgtgcccttgttaatttcccaaacattaggtaaataagtgaggcgtgttcctgccctgtattctaattgtctggcaagaaaaattttcagttcaggatgagatgtttgtctcttccaaaatctatatagcattaatctcattgagataccccaaaatcccaaatctgaagtattgaaaaaaatacataaaagtaagaaagggaagtgatgtatcccctgggatctactctactttttacaataaaatgtggctataagaaaaaaaaaatcacattatctaataattattaagtaaagctctgttgtgtttattattacatcggcctaacaattctcatgccttttaagcactctgatggcttaaagaagaaatactacataaagacataaaaaagaagaaatactgcgtgtctataggtattttgtgcatctaaattcacactgacttctcaaattatatagcgccaagaaaacagaactactccagtttaagagagtctttgccgttctgaatattgtttctaataaaagtacatgctattattgagagaaagctataagagctaatggattaaatgttggggtatattcccaattccaccaatgactgagatgttacccttatgccttcctgggcctcactttgctcctctctaaaataaagaaatttaattttgtctattattccttccaaaagcaaaattctactgcatttctgagacatgtgtgatacttacggctgcgttcagttttccactttcattcatactactcaccttaatcagggaatgtattaattacaaattaaagataattatttgactcattaggtttagggtatatacatgtcaaataccctcaaccctccctccaggtatatcaaacaaaacctcgagctcctactgctgaaattcacattttcctcttacttgatatcaacatgttctatttttatgtctcataaatttaattatctgctaaaatgaagactgaagcccaatgccccaaacactaatttccacaaatacggattcagaataggtttctaaaaatttcagtatcctatttgtcacaattgtattgaatctattatctttcattaaattattccgtgtgtgggtcactgttttgccctaagtgatttaccacccaaccttgccctcctaaaattatttacagtgcagctacacaaccgttttcagcatgctttaggcttgtacttcctggagggaacttcacttcagtgacaaaactattcatctgcgatgaacactaccactagctccagtgccacctcccatgtagctatgcagtcactgcaaacatgagcaagcctaatgcttgctgcatcgcacgtgatttcatttaacaagcagtaatttcccttttctctctgagaatgacttggttcaatgtaaataaaggccgtaaagtttagttggaagagaataagagaatattggaagttgtgtagcctggagtaattgagatatgcaggatgttccaagttacaagatttattgtgtatctacagacactttatgatacaaatggcaatgagctaatagttatacgtgcttctggtgtcatagaactttagatgtcatttgtcatttatttaaaggacaaaactgaaggaagttaggttaggtttaggaatcatcaaaagaaaagaaagtgtcagcataaggagcatcacaggttcctatatcctataagttataatatacattggagatcagaactttttcttttctatttctaatatttagattacagatgagctcagaagctaacctcagaaactattttaagaataaaacattccatcattgcaattgcgggaatcttattggcaatcattatttgcatgttggaaaaatggtggtagcggaggtgatacaaaaaggagaaatctaatgctaccattttgacttacttttaccaagattaaacatggccatcacaaaagattggcttcctaaactgtggacatcttcccagttcttataagtaagggatggtttacctcaaaataacactgaattaaaagtgacttgtgtccaaagagctaaagtcagcacaaattataacagcccatggcttgctgagttctcacaatttcaagcatttgcctaaggccttcctcactcacttcttctgtactcacactagctgacttcgggggaatccagcagtattgccggcccccagtggcacagtggcacagagcagcctgcgaccacgaagatgccggcagatccccgtcacctccctccccaccaagtgtgtggaggggccagctctctccgcctccctgatcatttgtttactgtgctcaagttgggattcttggccaataggcagctcaagggggaaagaaacacggtgtcttaagtgcattaaatcttcatattagccccctggcttggtaaacctttatgttggctttgttctctttttttcaagcatgacaaacaagtggtttttctttttcactttaatgattctttaaacaaaaaggggtagtttagggctttctccgaggctgataggtgtttctgtttaatgaggtttttattatactgtattggcttccctgaaaagaaattacgagcagcaaacagctgataatagaaaaaggctggaagaaacaataaccaagagggggaaaaaattagtgtggcagcagatgcacgcgttgtagctgcgggattaaatgccacttccattctcccttggccaccattgtgcaagtaataaagtgaatgtggacacttatgtgccagttatgtgtgtgcaaaagatatagatatagatatagactcagctaaactgccatctgtggaggaagaaggctggtgagctcagtctagacaaagatgagtgaagctcagagtgcggggtttacaagggctggtcggttaccatggaaactaattggagctaataagtaaagggacattttaactgtgggaacagaataggaggggctatttttcaatatcaccgttacctacaattaatctttcattttaggagtgtctttacttaattcttattatgaagcgcttcactctgtgcacaacctcaccctgctcaatgtacttgaaaattcggcatatcatcttttagaatgtgctgtattttaggtttagatctttcaagacagaatcaatttcacttttttttttttcttaaaaaataaactgtttgcagatggcaaagagaaaggaagggaggtaatggaaaattcttaacttctaaactgacactccgctgagcactaaagcagactacagagagaaggggagctgggaccttatcctgcagcaccaacttcaggtttttgtttgagttgattttccctaacaaaagcatttcagaacaacaacgaaaaatgtgcctttgtggacttactcttacaatactttccaaaggtagcatttacagctactgcagaagcaagtattaagatcatagcaaacaaccacatctattgcatccttgtattttttattttaaagcaagtattaaatcgtgtaaatagctgaagttatcaataaaagagaagcagtgactgagttttaatgaaaagatctacaattaataatagaataaaatgtccgtgttaaaaagcactttaaacaataatgtaggtcagaaccaggcccatttgggaatgcctcatagacagtgtgttacaagcacagggttgataaagcttcttgattccgcatctgtacagtttcttaggttttacttttgtaactcaatttacagtttaagagaatgcgaactaccttaataatgtctctggggtcttcaaaatctatgcagttgaggtaatccagatttccagacatgggtctggttggattaacccccctcccgccaaaacaggaaaaaaaaataccttacaataattggcactattaaaaattttatgatgcccaagggaagttagagccccgttgtgccacttgccattgttgaaaatgtttgtgttgattatgtatctggacttagctgattaggagtagtttagtgaatacacaatatattgtgaaacagacacctcataatcacttctgagaagcaattgagcaaatgaatcaggactttaacttctgattctttttcttccctccttcttctttataactcaattataagaaaaaaatgcactgcagaaaaattagttttctaattttgtacatcagaaaattgcacccagaataatttttaagtatcttaatataataccacacacaaaaattctggaaaaacacaagctagtcaaatcaatgttgctagaaactgaaataattctccttgtgatactagcatgcccatattagataactatttatagtctaaattttaaggcattaggcaagtttaagagtttttttgttttttttttaaaacaatccccctcccagttcaaagaaatacaaaaggtgcaatacttaaaatgttggcttcccacagacactgtcaggaagttggtagtgtttaaaattcctattttctctttcagtttatcaaaattccttagatatctgatggaatttttgaaattgtgagatttgtggcaattaattgatttccagatatcttcttaaagtactgtaacaagtatagccattttctggttcagactgctgtcaaagtacttactttcattaaacagttcagaaaaccaaaaaaaaaaaaaaaatgcccctaagaagaaggtattgaaatgaccaaaaattgaaaacatttcaaagcaaaattgttaatgagctgtttgagctatatggacattataagtgcaattaactagaagccaataaaaataatcaatgacagagtgcagccctctggtaccaaagtgcttttacaaagagatgtctgtgaaagcagcaagtgattaaaaaagccacctttatctatgggagcgcgtgctattttacatgagtagaaacgaaaatgattttcattgactatttctgaagttcagcctgtggcaaacagtgaagagctgtgtgtgggaatagagaagtttctgctcttagctgcgcccccaccccctccttgccaagaatgttggaggcagccacgatctaatcaaagaaaggtaggagtttagatttcaaaatgtagatgtcacatttcagtgccaactactcctacattaaccctttatcagcaagtcaagatgaaccttttatctcctatggaagggaaaacgtcttgctgagatggcccttccatagacgggcagtaaaaatgtttagggtttctgtgcatcccactgagggtccccatcatctcagggggagcacgaggagttgtgaaaagtaacgcacaactggtcatcagaataattcattccctccaccttctctgtagcacctcccacttctcctctttttatagcagtcctttctctctgaaaatctcaggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtaaagtaaaagacattgaatgcttctctccccctctctcttttagcatagttttgaatggaatgctagcacggcacacttgtcaaagccagttgttgctgtcctatcaatgctgctattgtacggctgacagatgacggtgagcatagcttgatgcttggctgtctttgtagaactaacactcctcatgccttgcttttgaaggtgtagctaagaaaatacctttgggagccgcgtttgtaccttttcatatccccgttgtatactcaaaacaggagctataacttgcttgtagaggatagataaggctgagaaaggatttattttagctttcaaaattaaaattcactttcaaactgttgcattttactgctcaatttataaagattctttgaagggtctattactgagttgctggcagaggtggaagtgctttcttcaccgatttgtgcaaggtagattatgtctgatttatgacagagcaaagggtgttttaaaatatttttggagattgactctgaagtttggaaactcctgaagagaaggggctaccctctgaacagccactaggtcggctttaaaacaaaaatgcttagagctggaagaaaagcagagaaggaagaaggaggaaaatgctctttaacatagccctcttgcagctgcagggaaagcagatggaggtaattgatttgcagatctgtttgtgaaagttttacaagtcatggaaaactaaagtagcatctctgtaatggatcattaagagtcactacatttataggttttagaccggctaagtgaagtgttaattaaacgtaaatagattttcaggtttggttataaacagacaaacagaaaggatttaattataaactagtcattggaaattaatagtcatctggtgcctgagcaacacaaaatgagttgtcatcatatatgcgagtagccgtaacggctctaccaaaagcacccaccaatattgaattgaactatttataaatataagaagggggtttatatgctatgtttaatttatagtattaaaaaaaaggcctttcaattcaggctctattttcacagggatcaaaacataaaattttttattttccaaattttctagcaagataggtgagccaatgagacttctgctaccctaatatacttgccctccgatagcaacattcatatacctgtggtatgcagagcttctggctcctactggactttcacatttggcagagaaatccagcattatcctcaccctttgcaggtgagagattctatgaataatattgtatataagctgttctgaaataagagctgtttggtaggttgaataacaggatttatggctagtgctttgtgattttagtattcgattgcataaagatgcctgtaaaattatgtttcaagttgcattatacatatttttgcaaccatgcagataatttttttaaaatcctttttttaaaaaagttaagattaaaacaatattttaatatggtctttaatttttattcaaaatgttctccagttatactctcaaacttctccttcaatgagaaattatcctcataaatacccaggcagttattccgactgagtattatctgattcccaatattacataaccaaaatagatccaagttcataagctgaagtctttcggagttccagtcattccattttggctttacaatggaaatgaggttttaaaaaataaagacagaaaggcaagctaatatctcgtgttgtatcaggattagaactacatggacagcatatagcatgcatggtgctaactaccaataccatttttcactactgcagaaatatttcacaagaaagtcaagtgcctcctcacagatcggattttcctccctgagatgtggcatgatggcatctaacagaggcaaggtgctatttagcaacaggtgccccaccagcatacatccctgatgttgcagatcgatcacagggctgcctggacaggactttgacagtatgggacaattcccctgaaaaaaacaattgtacacaggattaggcaggatagaaacaagaaaggaagtgtggagagataataaattcacaccttgaaacggcagccgtgtttttgtccccctaacagggtaatgtgaagttacttcgtgaactgaaagggcttgcttgaaacacagtgtccacagggcaatcccagcttcttgtcaaaatcaaaatctactgtcccaggtggtaaacatgcagagacatatttatggcgacctctacatacctcagtttgacatttggtttcttcctgacagcacttgtgctggtaatacacatgaagttcccatcagcattctaccagctgtgaaagtgtttgagcacacgggatatcccttccagagaagcgaaaaataatggaggttgaggagatctgaaatgtgcactcggtatgcattaaggtgacagatcttagaggtgaaaagtgatctgaaagcttgatttgtgaaagtgacaaaattcatttttatggtggtgtgcaataccaaaatacattagtccaggtattcactgaatccatggtaggttatgagtaggaacctccatcaggaaactagaagggttctactctgttttccttctaagaaaatgtaagtgacttcatgcagattgttgtagccatttccatcataatagtagagacaagtggcaaatgggacatttcctatttccttccctaattatgtatccatattggaagggttagaggtttgtttcttctgtgttttatattgaaaatgggtttattctttaaaaatcctaggaccgggcacagtggctcacgcctgtaatcccaacattttgggaggccgaggcgggtggatcacctgagatcaggagttcaagtccagcctggccaacatggtgaaaccccaagtctactaaaaatacaaaaattagccaggcacggtggtgggcacctgtaatcccagctacttgggagtctgaggcaggagaattgcttgaacccgaaaggcggaggttgcagtgagccgagatcgtgtcattgcactgcagcctgggtgacaagagtgaaactccgtctaaaaaacaaaaaaaaccataaagcaagatttctgatactgagctatatatagtattgagatttccccaaccatcgccacatagatgaggccaaccaaagagtcagctcaggacatccggttttttttcccctgtgcaatatttttgtgtggagaacataaagtaaatttaaggggattaaaatttttaaaaccagactctaaatagatggtcgcttttatcattattgactttggggagaaggaggctcatgtatgaaactaagtctatgatcatgtggtaaattcagcttttatttaggttagaaccatgaaaatttttgaaaggagatatcttatggaaaaaaattgtcctgaaatatgtttcctatttaaattctttttaatctatcttaatatcctgaggaggtggggaattcgccagttagcctttttttcccctctcatattttcctctcccctatagccagtctgtcatcaaattctgtgagtccttcctttaaaatatctcccacatgtggcccatagctaccatcccagcgcaatgatcatctcacatgtgggccattgcaacagcctcctaaatggtccacttgcctccatttccctcttctgtctactactgcagactcagcttcctaaaatgtcagtttcatcaaagctcttctagtctgaaaattaccacataaacccttactacccataaaatgaatttcagtcctattctaatgtgctggccttctattatttggcccgaactttccaaccatttctccccgccaaatccccacaacctcagaagtctacccttccttccagctaaagtgggcagcacagcatctctactttctagccttttctttcagccctaaccactctagttttctatcttgtctttaaaatgagtttgtcatcatgtgcacggttccttctaagtctacattcataagcctgtgtgtaaaatgccccactcagttcatccttatcacctctatatattcatccttcaaagtttcagcttaagttccaccgcctttgagaagcctctctgaccgctacctcttccagcaatgcttttcttcccttcatgttgaccactggttatctatggattgcacttaaaacaattgctttattttttattctgctctatagtttgcttctttattccttgacttctcaggtggagtgacagggactggcctggtccactttaatgacccacagaagaccctaataagtgtgcttactaaactcaccaggacattcgaacactcaagacactttcctctctagagttaccccaatttagagccattcactggctccggtagcttcctccccacccaggacaggaaacgaaaaaaaaaaaaatgaaactcagtgggttttatttgggggaaacttaaggaaaatgcccctaaggcagaaagtgaaataattgccccagattaagcttgagtattatatgaaaaatccctatgaagttcagctttaactgtagtagaaattacatgtattggctgctgctctatcataaaatcccaaatatggctttggagcaggagagtacaggctctgggttcaaacagacctgtgttctaatccagggaccacctctctagctgtgtggccttggacagcgaactgacccattctgagattcagctccttcctctgtaaaatacagataggagtacttatcttgggaacattttaaagaaaacacataaatcacctagctcagtgcatatccaatattgtatgttcaataaatggaagtgagagagggttgattggtgcatatgtagatccagacctaggatgcaggaatgacaaacgttcagctatgtcagtcattaatcctatgtatctatgatgtgccttcctttagcattttcttctgccaccaaaggcaggggaataaggaaaggagggagagagcaagggagagaaagtgagagagagagagagagagaaggagggaggtgctcttggcatttagggatttggagcaactgagctaatggctctgtagggacagtagtgacagttaaatacacgttgagggagaaatgaagcatgaagccctgggtcctgcaccaaggataataaagagcaggccctgggccactgtgctatgctgttggggaacaaaggaccccatccctgtaccatagcagggatttggattctctaagggtcatgtgcttcccttctttcctcctggctcaccatctagaaagaaatattaataaaaacttggcaaaacattgtagagagtcagatcgagcttccagaagtaattgataaagcaagataccatttagacttcaccttcaaaccaaatttaacaaaaaagctgaaagcaatcagcttgagccccttaccattcccaaactctgcacccatcatcaaacattgaaccttctatttctgccttttccctggaagggcagctgactgtgaaattctctaacaaggcactgaatgccacttagcaaatatgtccttagacattggatattcagttctagctttctgatcatctggtctgcacctgccctcagccagggagaggaaagaaactggaactgcctgggatgatgggtaaggcagtatttctggagatccctccctctccctagcaaacatatctatcaaattttcaaagagaggcattaacaatcacatttgacaccatcgtcacctgtagccgctaagctagtcttcgttgccctctaaatatgtggtccatgtactcctgcacagtagtgtattaaactttttaaattttaatttaatttaattttttgagacaatgtctcactctctcatccaggctggagggcaattgcaagatcatagcttacagcagcctccgtcttctgggctcaagtgatcctcctgcctcagtctcatgagtagctaggattgccagcatgcaccaccatacccagctattttttatttttaattttttagagactgggtctcactatggtacccaggctggtctcaaactcttagcctcaagtggtcctcccagttcagcctcccaaagtgctggtattacaggtgtgagcaaccacaccggccctaagccacttttaattaaaaaaaaaaatgtagctcttcgctttaccttcaaaggttaaatttttcttttgctgttttatttttgtttttgtttactacacaggtacaaacctgtaggaaactatgtctacgttttctaaaatatgaatctaagggacttggacatgctactgtttaactgctgtcggtgagattaatactaaatctctgtgcggaataaatgaacagacagattgtgtttctcaatcaaaagttttaattgtaaaaggtagactctctcaaaataaatctataaattttgggtcgtactaatcaaattctaaaataaagttagaaggcttgtgatgggagtggagtttgggaactggcaagagtccacatggctcttgttgaatataaactaaaaaacattctaaagctggatggacaatcaattcatgagcaagcctagacattttcataaaacagtatccttgtaagatggggatttgtcttattacatatccaatcacattataccataacaattgaattgtctgttcttaagcaatggactctgatgtagatttcatctactgtcatgtagttttcctcttgctcttctttgttttgctctattcttttgttggcattgaccaaatcttcagctgagcaacaaactgctgtaaccagatgctagttctgttgctagaattaatggaaactctgaactaatttttttattttgtcctatgatctttccaatcagtaaatagtgttactaatacatgcaactttttccacttcatagtacgcaaataatttctgagacaggtttgtttcaagaactcaggaaaatctccttgtattcctttgatgacagaggctcaaagattattcagtctaagtgtcttcccattttcctgaacaacactggcacatttagcccattcttaaaaaccaaaatggaaatctgaaatacaaagagttctgtttattgtccagtttttttggtatgatgttacaggcataatctgctatattaatttaaagtaaaactaaaggttacacaattaaaagatattagctataccagaattatggtgggaaaagactaattgcattccaatgtacatttattgatcagttactttagaagtgtgcacctctagatattatcttcaaactcctatcacaaatatgcctttgcttcccaatcacctttctgtcatataacatgtgttctgaatagacttcttgccaatttaaagtttcacccttaaccttcacctgccaataatcaatcttctcctgaatagaatgtccctgtaaacagatgtgctttaccgtgcatccagaaattcttgaaaccagcttttaactttcatcttataaaaagtgcatcccacaaaagacaggccccctacaaatcatgttctctttttttcttctgagaactttatgctggtaaaagaaaagaaagttttccgaatataacagataaataaaagcataggacatgtaatattttttacttgggatgcctagaggctttacatgtgttatcacattctttttcatatgtgatattgagatttagtaaaggagatttatgatatggacccaatatcaaacagattaaatctttttattttactttgactcagtttccttctctgtaaaatggagttaagtttatcacaaaaggttgttataaagattagatgagataataaaataagatgcttaacacagaatatagaacagagaaactgcacaaacacaaaacacaaaagctacatttttgttccaagatggcaaaagacatggcttgagctgaggcttggtgataaagtgagtatgtccttttcaaataaaaatagcccttcttaatctcatgatctgtatgacacaatttggaaatataatgaaggtggccacttggcaaagaagagaaagaggaagagggagggaaagaggatagaggcaaagaagagaaaaaaaggaatggaagaggaggggaaacattgtgatcctctcttgcctctgctctgtgccttgctataataagcatttcatgtcatagctaagtcaggccagattctagagtgtcctaacacatcaggtagagaggttggacttgatagctaaacagatgccttaggaagttcaagcagtaggtttttaagaataaagagagattaaggaaaaatgagagtgacagtgagtgagcagagacagagagagaaagagagagggggataacaagacaattgatccccagagttcaaataaattaaaaaaaaaatgttgtctattcccatcgacgcagtgggaataaggaaaggatgggtgtaagaaacatggtgaagaaataaataacaataatgcaacttggtgattagtcaaatagaggacaaaagagagaaaaatactgaggtatcaagcccaggacacagggaaatggtggctcaatctaaagctactgaaaatggaatttcattcggcaacacaatacattcccaaagtgacaatggtcattatggaacaaatgtttatctgttatctgtgaacagactacactcaatagaactttataatgcaaacatatgtaaatatatgtgtatatcaatgtttaataatatatgtgctgctgaagcaagcactcaatgtttaataatataatttaaatagatacaatctaatgttctgatcattggtgggcattagacagaatacacaactgtgattttcataaggcatatgccgccttagatttaaaaaaaaattttctcagattaagaaaatggttggccaagtaacaatctagcatttctataactttggggaagttacggatattcgagtcaaaatactcaactacatctgcataacacctatataattctcttcttttgactaagagactgttagtggagcggaacatgaaatttaaaaagtctagaggcaagaagagatgaaatatttaagttgcctatgctcacaaaccttcatattctaccttggaggaggctgattgacatcctttcacagaatgtaccaatgacttattcacaaatgaaatacacgttcccttcttcactacaaagacaaatcatccttaattttatgatttgggaatggtttccccattcccctgcttttctttctatccccttttgttttgtccttttttgttttatttgtttcaaccatttcctattcaaaataagagggccattctctagtcaagtcttcctactaaatcaatgggcagttttcagaactaggtatagatttcttagaagtagaagattgtgtttgccttttcaaactcgtgcattatatgttggaggcagcatgactgaaagaatacagagcttgagtcagcaaaatctggaactgaaatgtagccctgttactgaaaatttgtgggaatagcattgaccatggagacttgacagcattttcgttcctcaaaagagacttgggtcccattcaagtttttaatgaagactttggcctgttctatgttacccaactgggttttctgaaccatattccctagttcccctggaagaaacgccagcctaagtatcagcacctgtaatctatttctcactcagggttgccagacatgagggattaattgacatgagccagtttatatttggaagccattaatggctagcaactgaattgttgagacatccagtgcaacgaaccagagaggaaagaataacacacaagtgccatagttagatcaataaacatcatcttcggcaagcacaaacgttgggtttagctgccaaacttaaaactaggtctcttcatctagtacccacttaggtcaatgggccagggtcctggtatagagattagggactgaaacatgagttgatatttccaaacttcttaattttggattgtctaagttcagatttcaattcaagattctactcctacatgttacgcttttagatctgtcttggaggtacaaagacttctggaattagagaagtttggtccttctaagaagagaaaaatgaataagtagagaagtcagaaaaaagaatacaatgcagtcaaaacatgttctgtcatacagagtcaccttaccttttcgatgtaaaaaccaggacagaaaacggggggaaaaataagctatatgaaaaacttcatgtatagcaattgttattctcattagcctttcttctacaaaaatagctgtctattcatctaacattctggtgaactactacagtagtctcagaagtgaaattaaaagtgttcctacaattgcttctaccactgtcataacccctttggaagcttagaatactccacttaacttcctcatctgcttcaggcaaatcatatttcttgttgcgcaaataaaattaaaatgtatattttattattcccctggtaacttttcaagtctgaaaaaataattaagcacactattagcaatgaaataaaatttgctgaataatgacagcagtgttggagccaggaaaaagaggcagggtggtacagtggaaagatattagaaatctggattctagaacttggctactattaatagtgtgattttgagcaaattagttaagatttcaggagcatgccatcatctctttgcctgcattctgccattcccttcacctagatggcattattctccttctttactggcaaactctgctcttcctttaagacaagcttaaataaataaagcattctcctttgtttttttttgagaaagtgtctcgctctgtcactcaggcagggtgcagtggtgtgatcatggctcattgcagtgttgacctcctgggcttaatagatcctcccacctcagcctcccaagtagctgggacctccagcacacaccagcctggctaaatttttcctattttctatagagatgggttctccctatgttgcccaactggtctcaaaccgctgggctaaagcaatcccctgcctcagcattccaaagtgctaggattacaggtgcaagccactgtacccagcctaagcattctccttgaaactaaaaagaatggttggaggaaagaggaaggacttcaatccagttctgcatcacctcgtgcatctgaaataagctctgtaccttatctctttcttatctccactcatcttacctactgccattaaactcatcttatttctacactgtttcatcatatcactccactactctaaaacacctgtctcccaattttctgcagcatccagtctaaataaatgaccagcaattaagaacctccatgatcttttccactatgaccatcccactccccctatacactttctgctctttcctaaagtggttcaacatgtcctgaatttacatctttacttctgctacaaggcacgtgctcacactgttttctgggctaggactgcctcccatcatggttctgcatgtccaaattccatccatccttgaaaagaaagactcaagcctcattacctccatggaactttcttttcctaactcttccaaccatcaataatctctctctcatctgtgctctttttccacttaaaatcttgtcacataattttagctcttaattatgtacaattttgcatttattcttattctcatcatttttttaaattgccttctctctcttatattttgagaaacagtaagacaagttgagttttgagcctctgcatctatcaagcatagcttcaaggtggtagagccagtacatcctaaaggccttcattacacattcacagttagaatgatcaaggactactgggatagaacattatattttagtcattgagaattttaggaaactaatcagcagcacattcacaactaccccgggcattcttttgacaatgtggaaggcaccatctcatgcactgattctctggctcagattttttgtttccatcttctgcccacatcactctccagggctgcatttgcgccagctggattccatccagaaacagattcaaatagacaataggccaactagaattcccatcttccttgattagatgtgaaattgtatagctgggtgtcactcacatgccagccactcaggattctatgttatcaattaatttctcttgagagctgaactgaggagattgtgacaattctgttttcaaggacctgtaaaataacagctagaccagatttttatggatagtgctagatatataggcctgtccactatctgccgcatagcataaattaaaacaccctgttaatttcatagtaaatcgtattgggtgtttttttcttctgcagtgtgaatggattgtaaaaattttgtctaggaatggcattctcatttgtaggacaattagcaactgaggtaaaaggtttatattacttagaagaaagacgaacttattgcacactgtcaaaactactgaatcttatttgttgttgttgcttcaataacttagaatttgcagtggattttccaggaaaggatatcatagaaacacagaatgttggaggcgtacctccaacaatctaagctaaatctaagcagaatgttggaggcataccttagagatcatctaagcagaatctctcagtttacatctgaggaaacacaggactgggtttgttgggagacctgcctaaaatcacaaaactcattcttacaaggcagagttctaaatccaggctttatctttctaaaaagtatgagtcggtaaattctaccgggatgaaaatgagttcatgtgtccactttacattgggacccgacaaggaaaagagatgagtccagctcccttttcgaccatggactttcttgctgagggctaccgtgagtaatcaggcagtgtaaatgatgattgggactggaacaaatacaagaaaaagctttttttttttcagatgtactccttatggaaaatctgttctaattgagatcaccaagcaccgttgctatggatgatctgtgcaaacatgcagctttatcatagagaaacttctttgtaaaagcattttttaacatacacttaaagaacacactatccactgttgatgatgacaatattaaccattacgacttcaaaacaattttcacttgcactaaaccactggaacttgtaatatttgagtaaggaaagcagtgtgtcatttctgtacaccagaaaactgaagctgagggacagcatgccatttgcctgagtctaaacacctgagtgaggtaattagtgttagaactcatgtcttctggatcccacttcactgcctaatacttcaaatgatttcaaatataccatatttggtcaatattagggatacctattgcattagaacagttgaactgtccccttagtaatgtcaccttactgggaaataaacatttgaatacttcctcaagtactggaactttcccaagagaagtatatgagcaatattcttcatagcttaataaattacatgattgtatatacaattatgcatctatataatttgcatttgaagctgatttatttgtaaaagaagtagcagtattcattattagattataaatgtatttcctagtcataacttccatttgttattttgtactataaggaataacaatttaataactcaaaataaaaagattaatttagaatatcctaagtatgattctgactttttaaaaaagttttgtttttcactgcatgttctcactcataggtgggaattgaacaatgagaacacatggacacaggaaggggaacatcacactctggggactgttgtgggatgggggaggggggagggatagcattaggagatatacctaatgctaaatgatgagttaatgggtgcagcacaccagcatggcacatgtatacatatgtaacaaacctgcacattgtgcacatgtaccctaaaacttaaagtataataataataaaataaaaataaaaataaaagttttgtttttaagacatgttctagatttcctttttggtgttgtaagtatctcaagaaagccattatgatttccagagcaatgaaagaaatacgtcataggaaaaagagcattttcgttcatatttttaggttattggtcatatttcaatccactggaaaatgtgattgcaaatctggttagatttataaaaatatcaggcttaccagtattacaacttcttatgaaagtgtgaattctgttgagaatgtgaagataaagtggcagaataattatctttttttatatctaaactttataatagtgaatgctgttgaaaaagggattctatgaaagttattttttgatccataagaatactttgttcatactattttccttttcttaaatttccaatttttattttaagtttagggatacatgagcaggttgtgcaggtgtgttccataggtaaacgtgtgccatggtggtttgctgcacagatcaccccatcacccaggtattaagccaagcttccattagctattcttcctgatgcttttcctcctcccaaccactcaccctatgacaggccccggtgtgtgttgctccccgccattgtgtccatgtgttctcatcattcagctcccacttataagtgagaacatgcggtatttggttttctcttcctgagttagtttgctaaggataatggcctccagctccatccatgtccctgtgaaggacatgatctctttcttttttatattcatactattttcagctaagcctatacattagacacttctataaaacagtgcttccctatttcctatttatatctcagttgttgtttataatgaaaataaagtatgccattttcactactcaaagaaaagaccagaagaaataaagctgagctcttactaaactcttaacagctgtattcttgatcttccattgagtagcaactgctctttagtttctatcaccttgcctcaaacatggtcataacctccaccaaaaagaccacataaaatagcaaactgttgaaatgagaaagagcaccaagaaaagatgtaagtccttgcaggaggaatgcaactcaaaaaggatgacacagagggtgagggcatcagactcttttgctctcaccactgagaaaaatttggcactataaccggctagataatgggctctcttcatttgcactctactaccatttgtaaatcctctgaagttttaagtaatttgattttccccatagtttatgaaatatacaacctttagttttatataacaatttatacttttcaacatgcctttaaacatttcatttggttttgacaaccttatggatcatgccacataactaagtacttgtgcccattttaaagaaatagaaacagaggcacatctttggtgacacatactgaaatattaatgtatagtggtataagatcatgatgtgtgcagtttactgtcaatagttcaagggaggaatatatatatatataattttataaaatctctgtttgtatatatagagagagaggggcagggggagggaatgaaattgataaggcaagacattggggcaagtcgttaaccataaatgactatgggtaactggtatgtaagtgttctttctactattcttccagcttttccgtaagtttgaaattattttcaaatacaaatttttaaaaattaattaaggaaaattaagtaatttgtataaataaacagctgattagaggcaaagtgaacaactaggatccaggtctcctaactataatctatttctgtaaactgaaagtaatttccacttaaattatagtcagcccttcatatccacagttccacctcagtggattaaaccaaccttggatagaaaaactattcaggggaaaaaaatacaacaataaaaaaatacaaattttagaatacagtatattatatttacatagcacttaccttacattgggtattataagtaatctagagaggattcaaagtatatcggaagatgtgtgtagattatatgcaaatattatgtcatcatatatcagggacttgagcacccctgattttggtatctacagtggggctctggaatcaattctccaaggagaccaagggaacgagggagactgtatttataatcacaatcatacgttttgccagtcagtcatcaataatcaataccatagctcacgagaaactcataatgatttattaataacctttatttatatatcatactacttattgcaaactgttttcactgaccttattttatttggtcttcataatgcttccaatgaagtggattggacaggcattgtgggacccattttacagactaagaaacaggctgtgaaggttacttataccattaatgttcacagctactaaacggcagaatttagaaggatgccaagagagaatactggaaagagcactggttctggaatttaggatttaaattccaatatgccttcttagcattctaatgcctttttatactcctactgaccatacctaaaacttctagggctcgtattatatttcgcaatagaaaagcaatgttcttgccggcacggtggctcacacctcacctgtagtcccagctaatcaagaggctgaggcaggaggatcacgtgaaccttagagttccaggctgcaatgagctatgattgtgtccactgcaacccagcctgggcaacagagcaagaccctgtccctaacaaagcaaaaaacaaaaacattctcttaaagaacaaaacaaaatgactgagaaagatgtctgttttacttactaatgttatatgtaacaataacagctaagatttattaaatacatgcttaccatgtacaagtaagtgctatacatacattatctaatttaatttatgcaacatctctatgacatagaattatcttggtcccagtcttacaagcaaggaaataggctctgagagtttgactgacttggccaagtttacagacttgcaggggccaaggttggatatggacccagaaatctgactccatacccgctaccattaactagtccttattccacattttcctttttttcctttaagctcagttgactttttaacgaatgtcttttcctcatatttagtaatttttaaattctgaaattaagataatgctttctagaaacatagtttatatggaaaaatatttgcatgaaaaaatagaccctccttcttatttgcaacctcttgaaagcaggcaccacatcttatctgcatcaacagcagctcctggcacacatggaacattcaataaatgtttgttaaatgaatgaataatgttcagagttctctattaaaaagttcttacatgatctaaatacttaaagacaggacctaaaaattaagttggctcaattcaccaaatctcaactttatagtaaagcacacagttttggtcccagaaaaacaaataaatgaaagcagaaaacaaatttcacttttaagaaatttttaattctgcccttggaaagttgaactgctctgtggatgtttcaacaaatgtggcctttaactatctggataatcttttttagattataatctatagtctgcatgacaaaaagtgatgcccaggctcactaatgtctgcatttcattattttccttttgctgtaaccagataggatttaaaaaaggagaaacagtcaagcaaggaccatggtctcaggaaaggaggagaaccacctccaggatatacagcttgctttcatcttcctcttcttcttcttcttcttcttcttcttcttcttcttttcttcctcctcctcctcctcttcgagacaggagtcacaccatgttgctcagtctgatctggaactcctgagctcaagctactgtcctgcctcagcctcctgagtatctgggactacaggtgcatgtcacagcacccggctacagccagctttccaaggtgcccatcacagctgccctctgagcaatgactcaggaagggaccagttggagggaagatgggagctcaggaaaagtgtcaggatacaccttgcaacctccttcttctaacccgtgctttcagcccttccttttgtggtttcttcccactccaaaatttcccataatatttatttgcataaattttccccaaaataggaatgactaggcatattgagaggaccacatttacctaccgcccttcccactttagtaatagcatcattgttctaccctgtgcattccagtatagcacacagacatcttaagtgcagaacttaactttattgcaacataagggaatttcggggtaaaaactgcattcgtgaaatcaatcacacatggggctcaggttactcagcctggcatggttcaaagccttatagcaattcctcgtaggcgctgcctgttgtcactcccttggctgtctgtcacccttgcctcaggctccagccttagcctcagcttcttcttcctaatgcacctgccagccccagacatgggtactttccagattctgcagaatgaggctttttcctgtctaagtctcagcacatccttatcagcatctcacacagactgcaacctctgcagtcggcttgtgtccagggtcctagtccccatcactgcttcctctttatactctccgcccaatgcctgctcctgtgcgttcccacactcctgccctctggcatgtacagtttcacatttgtaatctatgcctctacgtacttacaagaagaggaggtgaaaaactggatttggcacatattgaatttcttggaccgtgttcatttttttctgtgtctggaatccactgttttctagcaaaaactttcttaagatttcaaacaccaaccctaacactctgagtttacctgcttgaatgactgcctgtccctcgggctgaagtcacaacattcaggttattattaatgattgtcaatcaccatctttttgggtccctgttgttttgccttcatataatttaatatttctatttaaacacagaaacttgggcaactgtcagagtcactcctcagctaatgctccctggaaagggcatatgctttttgctcactcaaggcagataatactgaacaagtgcttaagaacgttcatgccataaaagactctcagaaaaggaaggagaaactgaacgataccgagtccttacacatgcaggacacggctatttcctttcagattttgtaattcctatactggtcattctagttctaagtaaagaaaccaggctttttttaaaaaaaaaaaatcacaaatctgtagagctaggatttggacccaagtcagtttgtctccaaaaattcatgcgttttctcaaaagaaagttctatataaatgctaaacagaaaacccagtcattaattacatggaggcagtttacattttcctgcaatttacacctttttttttccagactaattaaatttcctacgctggtaaagtgcttcttcccacagtttactagagtttttggtaaagagctaaaagaaggtttgctgtgaagctggcgaggaagagaagactgagattccaataaaaacttgttaactggcgtgcaacaccgtgcctattaagagtagaacaactctcctacagaacacacagccgagtctatacattgcttgttaagtactggcccaagtgctcatgtctcagacttgtcccttggacccatgcccaagccagccctgagagggttggaacaactcccccgcccctgcagaaaacacgactggttatttagaatctagggcatcacaatgaacatggctcagtattttcataaggtattactactgttgttctgaaaaagcaaggcatgcgcgcacttacttaatatgttctttgttgatttacacgtccttgatttttaaatcacttccagaaattcctagtaaatgggaaaagaatttctcaaataaatatgttatcttttcctccaacagaatgccagatcacttcttgaaagatcgtttccagattcttcttcagttcaaactgattttcacaaacttgaatctgcacgccataattaggaagctactgcaggccaatttatttggttaatttgcatcagtctaaataatttttcctgacagattacttccgttctaagtaccaagtactttttaatcctagtcaggttattgctaaggataaatgatttcacatttctcataaagatgcctgtcattaagaatattaacacaaattccttccccttgaatagaaatgagctgtcattttagcaatcttgctgtgtcagcctttctattgtcaaacacaacaaatgatgggaaaatcaatttactctttagaattagtcaagtgaggaatcctttgaagtgggggtgcagagtttcgcctgaattctataatcacgtaacagcgagtactgtatgtatgttggtaaaatgttgtgaaatttaatgaggactatttgttgccataagaccttccagacagaatctatctctgaaaaagaattccccactcctaaaatagaggtctgatgagcaacagatgtggtttaaatgaacccttgttcaactgaaccaagaatatattgtgatctgtatgaggcacaattcagaagagaggggaggtggctacagcacagcctcagtgttgagtttggttgtggggtttaaacatatttatttatttcataaagtttctctcataaggcacaatgcaaatgagcttttaattaatacaatctaatgttcagaggatggtcttcatgctgtttataaaacaatttacatttttattttgtagtctaagaacgtgtgtcgaaaagcatgtcagtgagtagccataaccttcagagtgatctatgtcctggcaatgatttgtaagttccacaactcagtttctccacccataaagagaagattagatcgttgttcaagaatgacaactatttaatatttggaaatgactaaataatgaagtgcctggattctatagaaatgccgaggagaaaagaagattaatttcaaaccaaagtctagtgcaaacatgaccttcctattgtaaatctcatgaataggagaagaaataacatctaaagctttgtttctagggctgagactctggaaatatattaattttaggttgtttctgatggcaaaaaaaaagatccgtctattacaatctcttgcctgtggagatgagaaaaaattcttcctgctacctttgactgaaataatgcagttagcaaagatttaaatgacaagagtagaagtgtcatctttttgtccctttgcctctaggcaggactacagttaagccatctcaggaaagagaagagtgctattgctcccaaaactctccaggtgagaatgataaaaattaaaaacagcaagtgagaaaactcaggggccctgaaattaataaaggtcagttccagctcacatcgtttcagttaaaatttatttctatttggaaatagcctaacagcaaaactccaacggatgggctgtttggcactagttctcggtgaaaattccatttagtattactactactgtctgatctttttctattcagcctcctcttcaccctgttggtgagggagggaggccatcctagggatctggggatggccaaatacacagcacccaacagtggacagatgacagccacagcagcttaaaagtcacataaactcacagcccagggaaggaggatcagggaaggaggataacacataccatgcagggcacacaggggttgcaccgggaacagagtggacaagcagaggctgcaggaggcagtagtaacaagagaatgcggtgccctgaggctccccggggaaggtgtaattggcttgtttgaataattgtgtgggctggtaaggaagtaaaacccataaggttgaagacctggtggagtgaggctggcccagctgacagaggaatgagccaggtgggcgtcctttcttgctggaggggacatatctatgaaagcaggggagctcacagttaggccttggggggtcctgatgaggctcaaagataataaataccaaggtaacacgtgagattttaggcgttacaagccgatccatacaaactaaaccgacttatatgagactcatgttcccttgaccatgcctgatctctctaaggtcttttccacacctattttgtctcacaggaaaagagccacttttgactagattgataaaatgggagtttaagcaatttttctagcaggaggactctcaggccaagaccatgtaattagctaaatgactcatgcagaagtatcctacactcctccctttggtttgaatgaaaagagtaggagagccctaaatcatccagacaaattacatctttaactctttacttaattttagtctgtcacaaggtaaatattgacaaactttagacttatagccagagggctaaaaaaaaaaaataagtctagcttgccactgtggctgttttctgccctccatttttctttctttctctttttttttttttttttttttttgagatggagtcttgctctgtcgcccaggctggagtgcagaggggcgatcttggctcactgcaagctccgcctcccaggttcaggccattctcctacctcagcctcccaagtagctgggactacaggtgcctgccaccatgcccagctaatttcttgtattttcagtagagacggggtttcaccatgttagccaggatggtctccatttcctgaccttgtgatcaggagcatgagccactgcgcccggcccccgccttccgtttttcaagaatactgtcgggacacacacaggtcagggaaatgtagattctctcatttcccctggtttttaacaaatgtcctttatataaaagacaaaacttgagatgttcaggctctgtctgaaactactggcctcttgcatcctttagataaaggacatttgaagttaatgctgggcctgtcatccttagttataccacgttggacaaggcattttatcttctggatcccaagttccatacttttcttttttttttttttttttgagatggggtctcactgtgttgcccaggctggaatgcagtggcacaatctgggctcactgcaacctctgcctcctgggctcaagtgatcctcccacttcagcctcccaagtagctgggactacaggtatgcgccaccacacctggctaatttttttattttttgcagagacggggtttcatcatgttgcccatgctagtctcgaacttctggctcaagcaatccacccgccttggcctccaaagcactggcattataggcatgagccaccatgcatggctatactctttaatgaggaagttaaacaagagtttaaaaatttttttttagcaacaaaaccattgtctcaaacaaagtcttaagtcactctataaaacagatggagataatatttctccatttgactccaactgagtaaagtccaagccagattgcctggcctccctcacattcgtccccttcccacacactgccaaggttcctgaagtaccccttgaaagcctaaagcttgttggaacccagtttgaaaaccaccagatgagataatatctcaggtttcttccagctttcagtagaatagaaaaatcattgactatggaatcagacctagattcaaatcctagttctgtcactttctaagctgtatgaccagactcaatttacccatctgtaaacgaaaacaaaaatagttctgctaggttaaaaagacatgtaaagcatctaggccagttcctgaaacccaggagggatttgtaaatagtagctataataaaggttatggtcctcacctgagcataacaaaatgagagatgatcctacacttgaactacaaatttgcagtaagatcgctgtcattcctgaagccgaatcctcaggaacttgaggccaaaattctttaaaacctgaattggttttaattgttccaaattagtagaggggggaaaattcttctaattcactgaacaatctgtatgcgtggagagcatgtactgcatagacacaccccaagtctcttaaatgacaccacggtcgatccaactagcacaggtggaatttgaagcatgttacttttaccaaaaaataacaggggaaatgtcattaagaacactttaatacaaagccacaagaaattcagtatctgacagctcatgttctatatttcaccccatatcataaaacaattcaccagagagcagttgttcatttgctgagctgctgttgtgatagcacatattatttcaataatggaggagttcctccataaaatcagtcccagaagccagtgatgtctgaaaaatctcacctttggagaattttcctggcattctgtaaaggaagttgcacttacaggtcctctaatgtgcagcagcaaaggaacaacagatgccaacattcttgtttgcctcatgaacttaagccctaaagtaagctgacttgagtaaagtttagaggctccccttcaagttttagaaaagctttcttgtttaacttatgcaaatttacacaccctcatgaacctattgcatatatccgacaaccgtccatattttagtaccatgtggtggctctcacctatgcccatatagctggcgacaatgcaggtaagatctggtcagctgtcagtttcattcagtgaatactcactgagcacctgctttatgcagggccctgtcctgggccaccagggagaacaacgcaaggttccaaacctatggagacagacaacgcatgcggaatgacaacagagaaacagagtcacacggagaaaagaggggaaattggggaaggcttttgtgggggaggcgggatttgaactgagccttgaaggaagtgggtgtgaggatgggggtatgagtaaagatgggaaatggagaattgaaaggccgtctttagagaatgattcacattataacgtgctggggagtaggtgaggcgggagggcgggatgggaagtgggaaattagtgtggagacagaaattgtgggctttgagtgccaggatgaggaatttctttgcgtgttgggaagcagtggcaggcgcaggacaggataataataatttaaagaaaatatgagtagcaagttgtgggagcggggagggaagcttggtgctcagaataatcagaactttctcagtggacccaggctcagtggaaagagcgctctggttccgtttattgctcccacagagaagagaggagagacccagagaggtttaaaattagaggggtcgacagggcacagggaactcctggccaaccatccttaggaaaacaagagaccaggaataaagagaaccagcagaagcacctggtctgagtctaagaaacatcagtgtttactaagcacttggtctctggaacgcctggctttccaaataccacatcttcccatccactccatcctgccacaggcagctactgtgtcgggtgctcagggagccggaaccacatgcctggaaaccctgagcccctgcccgccgccgtccaagccggccggctgcagcgcagtttgtttgccgaggtttgcatgcacatattcagttgcccttttttttcccccagtcctttcagccgtgtcccgaaattcacccttagtgtaacttctgcctctgctcctcctcttcttggaactgccttttgtttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtaagtatcgtgctctgcttttactttaaaaagaaagaagacaaactttccttcctgtccctgtccttttcgtattatttattcattattcatcatattattattcattatattctcagatgatggaaagtatgtttctggccaaagtcttccacccaaatttggtcccttgtaatgataataagaggggaaagaggtttctgttgataattaattcacttaacaaaatagtacccaggcgaggtactgaaattggccactttcacagcattctggtgatgtctggctgttgatacacaccacacacacacacacacaacactacacacacacacacacacacacacacacacacacacacacactcctttttgcccttaagaggagccctagtcacctggcttgttagacaaggagaaatgatgccactttggtcttcagtttctctgccttgggtactcacaatttcaatcagttgtaattgttgaaagtttcttttcacactacgaaataaatcccatctttcagtgcaggcttgaaacttgcactggcttgggtaaactgtacaaaacactgtagctatagtggacatgtgaatttttattaaatttttcactgcataaccgaaggttctaatattaaagaaacatggacactaactttttaagcacaggcaaaactcaaagccctgttatcaaactatgtgtcttaaagagtgctgaattaacagagtactcttctcagagattatgctcactgctttgagaaactgcttttcaacaagaggtgaatttaaaactctagaataacatgaagaaagacacaacttctgaatacttagcaactctgacttgctatttgaacaagccaaaaaacaaagggtctattttgggcaattgtacaatttgcatttataaaaccgtgattataacttggtatgctatgagatacagagatttattgttttaataagatttcaggtaagaaaactaagaactataaattggtaataatgtagaaaagcaaggcctctcacttttaatgctgtaagtgctgtgattcatttgtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtggagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgggtgacaaagtgagatcctatctcaaaggaaaaaaaaaaaaaaaaagagagagactattgtagtgttccagtgagaactgctgggggcactgagcagtgtaggtggacaatagggcgcagattccagaaatatttagaaggtagaacattcttgactcagggctggatgaagggaatggaggaaaaggaaacttttataatattagttttgggcctgggctactgggtagttgtaatagaataccatagaacaagaggaggtactggtttatgaagaaaattgagttagttggagtaatatcaggttgagatatcactaagaggttagactgcaacgctgagtaaaaataaaaagcaatttttttaagcataaaattatcatctggatgtggtggcatgtgtctgtagtcccagctactcaggaggctgaagcaggaggatctcatgagcccagaggttcaaggctatggtgcactataatcaagcttgtgaatagatactgcactccagcctgagcaacatagtgagaccctggctctttaaaaaaaaaatgctagatttttgtctttgaaattttgaggagatacataaagactgagctctccctactatgttctaatgccccccaagaaatggtcactatctggactcaatgaaatcagagctttaatcttgtgtccctgctgccaaatgaatttttttctcattaacttttcaataggaagcccatgtctagggcagtcttgcctgtagctatgtgtatcctcaaagagagtaatttttacttcttcagagacttcagaaatgagcagagactaaagatctatgagctagtagaatacttattcataaaaagcacatatgcatgaagaagtaatacttatcaaaaacaaaccctttccttaacagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgggtaacattcgcaaattttttaaagatgacaactggaagaattttaacattttgaatgaatagaaatcaatctgattagcaggcaggaagctgtgactttttaaatcttgaggtctgattacttgataaccctggttttcttataccctttcaccctttctgtgctcagcacttaatcttctaggcaaagcctctatcggatttcctggatttcagagctgttaccctacctgagcacttcagagcaaatgccatttcttataaaaggggcttagccccagactttatggctagtcttgcaaagtggtataatatttctttctggtacgtgaactgtatcaacacatttaaaaacagatttaaaaagctatttccacctctaaatataaagagccttaccacttattagaaagatagcatttgataacaatctgaatttcttccacttctgatggctcacttaattcaccaaactttggaaatcatctttgacttttgaaatggtgaaaaacatttctatttttgctaaaatgcttttgccataaaaaaagaagtgtcccaaaaaggaaccgttaacatctcagctatgcaaaataatcaccaaatatatacttttgaataagatgactgcatcatgggaaagttcattatttaaggaaggaacaagatatatttggggaaattcccattagcacaattgaagtatgaagaatatactgagcttccatatatggtgctggtcattccacatttaggttactcaagccatttaaacttggcttcataagcaagtactacaccctcacaatctttttaggttagccgacataatgatttactcccaactgggtgctgcctgagccactgtgctttgcctctgcagtgtttaaagagtggatagttcgcagctgtgaagttccccagacacctgagtccaaactgttgctggattttgcttctttctgtgctccatggaaagctggaagctcctcaactttctcttgggtttggcttcctgttcacatgttttctggccccatgtcaattgtgtatgaagtaatagtcccacatgcgtgcaccatccacgatggcaagatttgtgtggttcagcatgagttttctaatgagcacactttggaccttccaacaaccctttaggaaaagcagtttggaaccagttattactttccaaggtgacggaagctaaaacagaatgttcttttctcttttttttttttttttttttgagacagagtcttgatctgtcacctaggctggagtgccgtggtacaatctcagctcattgcaacctctgtctcctggattcaagcaattctcctgcctcagcctcctgagtagctgggattacaggcacctgccaccacgcctggctaatttttgtatttttagtagagacggggtttcaccatgttggtcaggctgatctcaaactcctgatctcatgatccacccacctcaccctcccaaagtgctgggattacaggcatgagccaccaggcccggcccagaatgttcttaagcaacaagactaaagccacttttaagagacaattaaaggacaactgcataggaaaaatgaacatttaccttacacatctgtctaaatgtgtgtatgtgtaaagtatataaaaatgcctccaattcacagtttaaaaatatcagttactgtttcagcattttgctactgatgaatggtgctagtgttttccactaaggactgttattttaatgacatttctctgcagcaaaatttgatgagtttacaaagtttcagagccaggaaatgcagcttgatttctgaacaacggggacaaccaagagagttaagttcaatcatctagttgctttatagcatggattcctaagtgctaactgcagtaacacactgacacagagagcaaagccaaaccaaactcttaaagtacagctgttaaactatcaagcttaacttctcgatatattctcaacaggtgaaattctggcacacacccacacttacttgaagatggtaatgtcaaattaatcaccatatgtccaacattttatagaattttagagtaagaagagatattggaggtcttccagttttaccttatcctttcattataggaacagaaaaactgagactcatgagtgctctctctctctgtctctctctctctccacacacacacacacacacacacacacacacacactcacaagcacacacacatcagagctgtactgagtcatgacttacagaaaacatcctaagtctgacttaagcaaaagaaagggatgcaatgatccacagctaggccactggcttcctggtcctttcaagtttgtgtggccagcttcagcactgtgggctgacaatttattattgcttgagaaaacattcagagtcttggagtctatatttttaaccaaaacttgaataaactctaaaacaaaccaaggatccatcggtgactcagatcctgactgtcctttacagtgaggctcagccaccttccaatagttactggggccacactgtgatcccataagatggagacaaagcccaagacacaaccctcactctgagggatcctgaaacctgaccagagagatgagaccatcctgcatgcaggccatagagacggtaaactaagtaccacactatgtggcacaggttttaaatgttatgagttctagtgacagggattaatgaaaatagaggctgtcagaaaatgagattttagctgatcccagaggggagattagagttttaatatgtggaggagagaaaagtggacttttccagataaagaacagaggagtgaaagcagagagaggactgtttatgggtgggaccccaaagaagctggcctgaggaaacatttctccacccacgcaatggaccatggagctccagtacagacttaaaattatttattttgagacagagtcttactttattacccaggttggagtgcagtggcacaatcttggctcactgcagccttgacttcctgggctgaagccatcctcccacctaagcctccctaggagctgggatcacaggcatgtgcaaccatgcccagctaatttttgtatttttagtagagacagggtttcacaatgttgcccaggctggtcttgaactcctgacttcaagcaatctgcccgcctcggcctcccaaactgctgggattacaggcatgagccactgcaacgggtcccagacttacattattatctattaaaatgttactgaaatatgtacccaaaaagctatgtataagttgttttatgtttgtatagctataaatacacattagcataattctatttatactattaaaatttcaaaataagtctctaaggataaacgaaacccatacaccaataatactctaattcatattaatcctctttgccagatgatgctgttttgctgaaactaaagaataaatttgttttaactaagtattcattaatgaaattggaaaaaacattttaacaaaaggaatttctattgcatattaagaattacacctgtttataaggaactgttacaagatggcacctatagagaagaaaggatccaggcaatcagtcctctggggtggagattttggagctgagaactgtgagggccaagtcatcctatcacccttctctattctgggaaacaaacaaaccttcatacaacacagcaggaagtatttgactctcacgtgcatacacatatcagcaggaacttaggctgcctctgttctttcttcaatagcccataacaattaaattattatatgattataccacacattattattatttatttttttaaagacattctagctctgtttcctagactggagagcagtggtgtgatcatagttcactgcagcctcaaacacctgggctcaagtaatcctaccgcctcagcctcccaagtagctgatattacaggtgcacaccaccacacccagctagtttttaaattttttggttgagatgagggtcccactgtgttgcccaggctggtcttgaactcctggcctcaagcaatcctcccatctcagcctcccaaagtgctgggattataggcatgagccacctcacctggcctacacattatcattttaatgatgagaaatcaaagtctacatttataaaatttaagaaaattctggtctcatttcatgaaaatgtcttttgattgcaaatatgcaaggaaggttgtatctttattactggtctaaaaaaaatcagtccaagtaataatgattgccgatgtttattgaacccttattttgtgctaggtcgtcttgcaagtttttcacatgaatgttttcatgtaatcctcacatcaaccctatggggtagataccattttaaattcccatttgtcagaggagaatactgaggcatagagaaattaagtaatgtgctcaaggccacatagccagtgaatgccatagcctggtattccggcatctcattccagactcagctgcccggtagcatattcagaacagtctcagaaaaggtattctttgacatcagactgtgccagcctaaccacagccagatacttttgacatcacattcagatgtaaactttcactgtaggagatcatgaggtgcacatacaattataagcacaaacatgtatatgtcctctcagaacatattttacaagtgggcatctgcatgatgcttctaataatttgtgatatcagcaccatggagacaggatggaaaagttcttctagaactccccaacccccaggaggagaagcacagtgaagcgagtgatctagaggcctaatgggtgaggtgggccacattgcagagggtggcataaaactagcggcggcggagtttcactgctgtttggagtggaaagaggggtgatgagagtcgtgtgggaggaaagtgaatcctgcagcaccaggccagctccaaggaggcactgctgcagcaatcttgtggtaggagtgatccatccagagcaaagcaaaggacctggggcttaacctgactcgccaaggccagctcaggataaaaagagattccaggcctatggagggaaaaaatctgcacccattacctctgagatccccccatatgtatacgaaggtacaactgtagtcaccagtggaaaagtatgaagactttaaatgaaatgctttattaaacattaatatttacatgggcatgatcaatattttttaaatgtgaaggaaattctgagttgttaaataagaggtctcatttccttattctatcttatattatgttctcttttatatcatatgcacatttacatacagtatgtatatgtcagatgttcatggcagcaagattgcttcatttgatacttaaaacattaaaatgggaatttcctcatattcaaagtgttcaaatttattttaatcacttacatttttcagctgtcaaaaatgtggaatataaacaaattttaccacttggaaatgcttactttgctagtcatcaaataatagcttgctgcaactttaaaagattccatgattcagcgcgttttcctttaaaataggtctcccaacctgaaattagacagcactcaacctttaaacttggaacactttgtaaacttttaaaaggaaactcttctttaatggttctatgaaatccagtcaaagaatgatatgaaatgaatctaatggaaagtcttttccttgttggagaagcagtcaaaatagaaacttctacaaaaggaccgaatcacccacaatgcttcaaagactcttgcgagtgattgtaagaaaatcggtctggatgaaatttagagaatattgttcctaatgatcaccccctttgaggctgtgaaagggcaacatctgaaagatgagaggaattgctgataaaacgtaactgatggcaattttgctcttttccatcgtaggtgctgacggccacccaccatcatctaaagaagataaacttggcaaatgacatgcaggttcttcaaggcagaataattgcagaaaatcttcaaaggtattcatcaaatttttatctctagcttaaaccaaggaccacctgggcactctatgtcacttgaagaggggaacatttcacggttggggaattgttaagaactggcagaaactgaaaagtcaatggtcctctaccttcccatcacattctcattcttgttgactgagagagctaaaaggggccttccacgtggtagagccatgtcacgaaatcagtcctaagaaatgtcagaagaaccatctgaaaaatgggaatctaaacaatcatatgactattgacatattatgagctgctcaggaaggaagctcaggggaattagggggcagtgtggtaggcccgccatgcacagccatccacaacatactccacagtgtcaggagtgaaagctgtacagatatctgatttattcacagctcgtcttcacagtttctttccttggccagataaacattagtgccaagagctttcatggagccagggagagttgtggcaacccatctcagcaatttcaccttggtggcaaaaacatttctagggtttgggttcatatgagggtacaacctcatgaggctttttcaaatgtcaactttgagagttgctccctttcacccctaaaaactaatgcaatgaaaatgttcagttcctctctatttcattagtcactcttcagaatcattgctatttgcttgattttttttttcttttctttttctttttttttctttttttttttttttgagaggaagtcttgctctgttacgcaggctggagtgtagtggtgtgatcttggctcactgcaacctccgcctcctgggttcaagcaattctcctgcctcagcctcccgattagctgggattacaggcgcctgccaccacgcccagctaatttttgtattttagcagagatggggtttcaccatgttggccaggctggtcttgaactcctgacctcaagtgatccacctacctcagcctcctaaatggccgggattataggcgtgagccaccacaaccagcctgcttgatttttattctaagccttccgttggcccaaggtggcttggaataagtcctgtaatcaccaaaactttcatgaacctcacctaaaaagcaacgtcttcaagtctggcccgaatttcaggtttgccttttgagggttgttttatccagcttctctttctaatacttatcgaattaaacatttttgccttcattctacaagtattacgtgaagaaagtgaatggttcaaagtgtataagacaggttagttctttgacataaagttataagcatcagcagtttttctagaattcttggagctttgtctgaagatggcatggggtattaacccccatggctgattacagcactgtatcagatgcttgtcataaacgagctgaatccacagtaagagaagataagttgaaagttaggtctccttacttcaaagctctaacgtaagaaggaaatattctaaaacagtaacttcaaaagataaatgtttaataattcaatgaacaagttcattgaataactaataagttcaatgaacagaactggaacttctcaagagttatttatctcttgaatcaggttgtgaacaattttctttgtgaaactctagcctgatgcatcaatttttatgttggaaaaaacaaggttggccttcagtgccataccattcaaaattaaccgtagaagagactggaaaacccctgatactacaagagcacccttcatcttctgaagaggtccctgaggatctgatttctcaaagtatctttcttagtttctcttatgctatgaagaagccacttttctttctttccttttttttttcttttcaaaacgaacagagtcttcctttgttgccaggctggaatgcagtggcacgatcttagctcactgcaacctccgacccctgagttcaagcaattctcctgcctcagcctcccaagtagctggaactacagacacgtgccaccacgcctggttaatttttgtatttttagtagagacagggattcaccatgttggccaggatggtctcgatctcttgacctcgtgatctgccagcctcagcctcccaaagtgctgggattacaggcgtgagccactgcgcccatgaaaaggccacttttctacaatgccatgttgtttgttatctagctggtaatctttcatgttgcacttttctccccctaatgtgtgatttcaccactgtgttatgtcttcttcacttctcagcacatctttattatgggaaaatacaagtaagtgtctaggctgggcacagtggctcacgcctatagtcccagcactttgggaggccgaggtgggtgaatcagctgaggtcagtggatcacctgaggtcaggagttcgagaccagcctggccaatatggtgaaaccccatctctactaaaaatacaaaaaattagccgggcgtggtggtgcgcgcctgtaatcccagcttatcaagaggctaaggcaggagaattgtttgaacctgggaggcggaggttgcagtgagccaagattgtgccattgtactccagcctgggcaacagagcaagactctgtctctgaataaataaataaataaaataagtgtctaatgttggatcatttagattcacttgctcaaatttaacatacagaacatttttcttgaaaatctatggattctgtatgagacctggcttcaatctacttttttttaatcttggggctggaaaattcaaatttaatgtttggcttcagagatctctgccccttttcaaccaactccaggatttgagctgaattagataagcagacgagtcacttcccaccactacctctgtatttatatatccacaatcctccttctagtcaattttatggaaagaaatggatgtttttgggtatgtgcttggacaatcatgtttataaaatagggaccactttactggaccttagagtttcaaaatgctgccctgtgcatttttgattgcctctctgctcatatcatttgggtataaagttctttcatttaatattcagaactgcttacctgtagctcattgaacttggcatcacctctaaattacataacccaagagaaagttcaaggagatactataagcaaatctcagaagctgcccaagcatttcctgtctttcagattgccagattgtcccttgttccaaggagagataggttgtattcacatatgagaagacaccaaaaggacaattaaatttcacagcttgggggagattttgagggttctcatcaaaaatgtttacacctatggaacagattgcttttgtgtatgtgtgtgaagcctggttttcagcttaaaatacacctgccaaaatatgaatggcctttattgtaccttctggacactaatattgcactgttggacaaggtttggtgcgcacagatgggataacttagaacagcaactatgttgtttttgagaaaattaagatttttcctagccttgttaatacctatttgggatggaaaattttattataaggatggcttagctgtgcctggcactttatttttaatattattttaattattaagttaaatttagtatattaatctaaatgtaggtggtttttaaaattgcccgtagactgtaacagtaaactaaaccttttcaaggaatcaatatcagatgtggaccctaaaacttatccttgtcttgctttaagtgcatattggataccaagacaatgataatttgtcttgctgcagaatatagagacctatatttgggggtgctaaaaagtagactcttttcctttgtgattccccttacatattttgaaacatttctcattgaagaggacaatttattacacagaatatcaactcatttaaaattaggtatttgttgtaaaaaccatataacagtcgcttaagagttttttttttttaaatcacacacttaacccaaatcagttggtcttttctttataagtatatactaagtagaatcatagaaaattgcttctatttaactattgttggcctacaaaagcagtgatttcatagggtattatctaatattttataaaattggaaacatggagaatgtacaatgtttattgttttgttttcacctacctttgtgtcaaaacggttcatacaatttctgcattgtctttttagttcttttaaatttgtgcattgtgttccattacatggatgtgggacatataagttgctcatgctttttctttataagagagataacactaaacatacacacacacacacacacacacacaatcaatacctcccttcacgtagccattctgtttagttgcattttaatgatggtttttaaattgtcttctcctgcaccatcctcttatccctttgagactaatcactttcacatgtgagacttcaatgcaaatctaagtgataagcaaatgttagtatgtacaagcacacagatttgcacccatgtatgtacatagctaaatggatctgcttagaccacagtcctcaaagccagtgagcttatgtttaaagaaaatgccaaactccaattggatgagaaacattgtgcccatcaggctgtgccatcttttgcaggctcctctctcctcccatctgactgagacctgtcccagcaggtggctctgtcagtatgcttcggctgccagtaaaattgtgctttgcctgataatggtgaggaagcaaactccagagatgttgaccaacccaaggaaaactctttgctcttgccataatgatacattcaggcaggaagttaagagaaaaatagctcttcccctggcaaggaaaggagtttaattacgatgagggtggggactgggggacattcacaagtggatattaaggaaaaagaatgggatgatgtcattctttactgaggcagtcactaaaatgaaatcagctcacacaacaatggtcttgttctatgctcaaaagcgcaagttggtatgagacattactttgcggtgatgctctcaggaagggcctaaggggccgtgctcacatgaaactatttccccaaacatcttgaagacaggtcaagaagtgcagaatcattccatccagtgctgaaatggcccacactggaccatcatttgtttcagatcaccatgccacagtttaggatagaaaaagtgtctggattcttacaacaccatgaattcaaagaggcagaatatagtggttcaatctggtatcaggccagatgttttaaattggttccttttttgcaggataattttaaatggcatactgaaattaacatggaatatattcctcagtggaaggtttcaggaagtcacttcccaagaagaaatactgccttgtatcgtgctagagaatttgtagggctgattaattccacttacagaggaagcatttgatctatgttgatcttgagtccttagttccaatggcaaatattcaattttaggttccttttctcaatggtgtcctaatttgaccgcatttatctgcttagatttcacaagagtgcatcataattataaatgaagagtagactttctaagaagccattcctggaataattaggtggtggggtcaaatcctgttattaagattctgtcattattgcattaaatagggcttaaaacaaataagccattggctgaggccttttttgaggatatttttactgcaggaatatttataataggagaattgaagtactataggctttttacattggtatctgcagtttagagaatttgcaaaaaaaatattttttagtaagccactggtcttcaggtgtacgaacatattgagatatgaggtccttctctctcttgcagattacatgaaaatgtaaaaaaaaatggattacagtggaaattcatatttgttttatgattttgctctcaaattattcaagaaccttgtgtcataatctggcatgtaggggaagctgagatgtgtatgggacaaatatatttgaagactgctttggatcgtggccatcagaatgaaaagaggcacattttgaaggagtccttttttggcagacactaaagtaaacctcagggattcctgctacccttatttttaaaaagaaggtaattcagctgtggggtttttgagagaagataattattatttttttttttttgagatggagttttgctcttgttgcccaggctgaagtgcaatggcacgatgtcagctcacatcaacctccgcctcctgggttcaagcgattctcctgcctcagcctcccgaatagctgggattataggcatgcgccaccacgcccagctaattttgtatttttggtagagacggggtttctccatgtttatcaagctggtctcgaactcccaacctcaggtgatccacccaccttggccttccaaaatgctgaggttacaggcatgagccaccaggcccggccaggtaattatttaaaaataaaaagtaactaaaatatttccaaacaaattgtcagcaccatcagaagttctcaagtttccaagaaagtgcttaatattcttttctatttgtttattagtagcctttaaagaaatctaagttcattatctgcagtcagttgacactagcactgaaaatacagatggaattttaagcaaattcattatttacaaagcaaataagtgagtcctggtatctgacaatgggattcaccataaaattaattttaaaattactaggttttaaatttttacccgaaaatgatttgatgcatttttgcattaaaaactgtatttattacatgaagtataaataccccaggagattaaatccatcctgccatattcatgggagcctgatctagcccgaggtatgatgcccagcaggacacagtggccataggagaaaggttagcagccattcagagcagtcggtgctgtgctggaggcgttataggtattgtgagtatctctcttcatggtaagtagccataatataatgactcataggattcttctctccaaagaacactgtgctgagagtcaagatatcggctctggttttagtcatctaatttactctataatttcctacaaaattagaatgtacttgtcccatttccctcactaggatgtggtaaagaccaagaacataaaagcacttgtagggggagtagacatatgaagccactcaaacacaaccgattgttattgttgtaatatttaaaggataaggcattacatggtgatcattagttcccatcataactgtgctatttccatcaccttatttctctctcattatccttttagttttatgtctctgcctgccagtaaactaatcccaatgtgtattttttaatggttggcaaaaattcaaaaatgttcttgaaaagaaggaaggccatagaattgccaggattataactatgtattcagtgcattaaaaataaaaaataatataacaaaacaaaatagaatgaaaaatctttactggcttaagccttcaaaataaaagtgaaaaatatagcacatactgtattagatacttgttgttggaattcagctgagggttgacttcaaatcatctttaggattagaaaaaatttctataattaactcacctgggacatgtgctgctgcttttaatatttgttgattggctcctgttgggcactaaagtgactgaaaaattgtcatcatctggattccccaaacagcagccagagacaaaaaatgacatccctctgctcactgtccatacgtgtcatgaggctgcccttctcacagggaaatattcaattttctttttgccttttctacccccaagcactgacttatggaggaattttttcaaatgtcatatacagtatcagcttagtagtctgtaagtgctgaaatgtccctcctgggtaaaaggagaggaatgtagtttacatttctcatttgaaagtccatttaggttaaacagctttctggttgtgaaaatattaagacagagtttgtatgacatgacttgtgcatacatgtttgaacgactgttctagtgatagccaacctctaaatgtgacagacaataattctgactataaaaacattgattttttttctctgtaactcatgtagacagtaataccatgtatgcacctagttataactagctgagctattggcttttgtggatgtctgaaaatatatgcagtgatatatgtcagggtagtgcaagaaagagcccttcctaccttaggaagcctttgggaggcgttcaagagttatcacccacaaaagtgaacttgtcttctcaaaatgggaagctctttcttgtcctaatttagagagacccatgagagaagtatggtttaatggttaggaacacagatttgggagccagactgccagggtttgaatttccactctgccatttgctaactgtgacttaatttctttatgcttcagtatccttattggaaaaataggggccagtaatgccatcaacttcattatgctgttctgaagattagatgatttcaaatgtataaagggcccatacaatgcttaacaattagtaaagtgctttatgcacagtaactatttttatttatagaaattcaaaaatccagtaattcacaaagcagaaaataatgtttttgtgttgggttttttggtgggtttttttttgttttttttttttttgagacaaagtctcactctgtcacccacactgcagtgcagtcgtgtgatcttggctcactgcaacctccgcctcctgggttcaagtgattctcctgcctcagcctcccaggtagctgggattacaggtgggcaccaccatgcctggctaatttttatatttttagtagagatggggttttgccatattggccaggctggtctcgaactcctgacctcaagtgatccacccacctcagactcccaaagtgctgggattacaggcgtgaaccaccatgcccagcctgataataatgttagtccatatcatcattacacacacacacacacacacacacacacacacacacacacatattgtcaatgtatcaggtattctgtagaaacctgtctcaggactctgcacccaccctctggaaaccagtactagacaggagcaggacctatgcatgtgcctcacacataatagtaataacaataccttaatcttacatgtttaaaatgtacatttgcacacttgtgacacttattgagaaaaccaaattaagcaatgaatgggaaactactttgggaatatattatcagcatctgtacagatggaaaaccttttttaaaccagtttttaattttctaatttttgttttctctttggatttgtttaccctttggttcagatttttttctcccattcaatcatgatttgacaaatactaataaataacaactaataatcacgaaaatccgataaaaagatcctcctgatggagacttttaagattcagtgggtccagattctgagccctaactggctggatatttttactctggtctagcatctcccctagtacaacatcacagagctgcatgctgagcttcacgaaagagtaaaatagatctgcctcatcaaaacatctgttgagacttaattttttagagccatttttggttcacagtaagattgagaagaaagtacggagatttcccatatacccctgtcctcacacatgcacagcccctccattctcaacatccaccactagggtggtgcatttgttacaattgaggaacctacactgacacatcattgtcacccagagtccacaatttacattagctttcactcttagtgttgttttttctatgggtttggacaaatgtataataacatatattatcagaacattttttactggtttgcaagttatatacattcgatgacttttttacagctacaactataattagccacactatttaaatgatctaattttaaagctccaggttaaacactgcacagaatagcatcctgcccttctattttgccattattaagattccctcattgaaagatgaaaataaaattcctagagaatgatgaaaaaaagcatcacgaagagaagtttcctaagtattatggagatgtttcacacagcatagagcactaattctgcttgtgttttatatttttgaaaacaacactttatatttaaaattcaaaattcaagtcacatatcaaatgttgccataggatctcaaagtaacaaacatagtgttcggtttccctacttctctttctttgtcattaagtatgtgacagtgccaagggctggcaagtccctgctccaccaaagggagagtagaaaaagtgcctcttgagcgagtattgtagaccccatcagcccaccaacatctaccaagtgaaagttaaaggtgatcatcagcatggcctgaaatgaacaacagggccatggcttcttatatgtacagaatccagttcaaatcttttcaaagccagccaaggaccatcggtatgaggaaagaaatatggtattgtaaaaagacaatggagagactccaccacttaccagcttgtgaatctgggcaagccgcatgttcttttgggtcccagattgcctttctgtaaaatgtggataacagcatttacctcataatatcgttgtgagggactcaaagagaagctgtgtgcagaacgtcaagcctagagctggttggagagcgtataaccgagaagcattcatttttctcctcaccttgtcttagcacgagtgttctttcctccttcacctcccccctcttaacttggccctaacatatctcatcttagctaggttccccaggttccctacacaacaccccagactgctcttgcttcctcagacatacccttcatgggcagagccttgcaactgacataggccagaatacccttgtgccacacttatgaaaagctaaaatgtgataacctttgtaaaatattccttgatttccttaacttattattattaacatccagaatttatttctccctttgacctcttatggactttataccttaattatgattcatatttggtaccctactgtcatttatatatctgtgtttcacattagattctgtgtgtttttagactaggatattatctgtctatttattcttagatttagcacagtacttgcaggtagttaagtacacaataaatgttcattgttaatttaaaaaacaaagttgcaacttaaattttaaaacactgagctttgtgaactgccaaaaagaggcatccatgctttgacttgggccagtccccttgtggtaaatttttaagatcacctacataatttttcttctatttgcttatgtgtttgaatatctaaaagactcctgtggaaatagagccagaaataaatattgagaagaacctctgggctggcatctgtcttagagagtttagtgagaaatacagctacataaagagctgttgtgaaaggcaagaactccatggaataatgaatgaataatccccaaagctctttgccatacaccaatgtctcttaaaagtagcatgttacaaagtattactgtggaagaccatcaacctttggtcataggaacactacatagacaactttaagcctaatggtacaatcattcatggctaggaaataataagatataggcatcagaaaagccacatttgtgatcaggtgcctgaaatgaggtaatttaatttgaacaaagcccttgtgaatcccagggggtgaaaagggcacagccaccacctgttgtttcatcagctcaactggactgaaggacagcctgcccatgcccttggtgtggccagggtttctaattggacttccatcatttcagccacattacagaaaaggaaagaaaagattccaacagatgctaatagttgagagacaaatagtaacacacactcttaataagttttctgtgaaaaggctctaaaatgtatttttgttgttgtctaaaaagataatgaaaaggtaacagtataagggaaagtttcaggaggcctgagctttgtcccagctgcataactgactggttgtgtaaccttggtcaagtcacttaatctttctgggcctccatttctcatctgtaacatggaggtgctcactttcagcactgagattgctgactgaactctaagattatgcttttactgtattctaccccagattgtatcaccttgtattagtccattctcacattgctataaagaactacttgagactgggtaatttataaagaaaagaggtttaattgaccgacagttctgcagactgtacaggaagcatggatggggaagggctcaggaaacttacaatcatggcagaaggtgaaggggcagctgtcctacatggctggagcaggagaaagggagagagaagggggaagtgctacacacttttacacaaccagatctcatgggaactcactcatggaacagcaagggggaaattcacccccatgatttaatcacctcccaccaggttccacctccaacactcaggatcacagttcaatatgagatttgggtgggggtacagagtcaagccacatcattcttcctctggccactctcaaatctcatgtccttgtcacatttcaaaatataatcattccttcccaatagccccctaaagtgggggagtgggaggaggctgttccagcattaactaaaagtccaagtccaaagtctcatctgagacaaggcaagtcccttctgcctatgatcctgtaaaatcaaaaacaagttagttacttccaagatacagccagggtacaggtattgggtaaatgctcatgttccaaaagggagaaatcagccacaacaaaagagttacaagccccatgcaagtctgaaacccaggagtgcagtcattaaatctcaaagctccaaaataatctcctttgattttatatctcatatccaggccacactgctgcaagcagtgggctcccaaggctttgggaagttctgcctctgtggttctgcagggtacaacctcctgggctgctttcacaggctagcattgagtgcctgtggcttttgtaggtgcagagtgcatgtgttggtggatctaccattctggggtctggaggacagtagccatcttctcacagctccactaggcaatgcccctgtgggaactttgtgtggggactccaatcccacatttcccctccatacttccgtagtagaggctctccacagggctccactcctgcagcagacttctgcctggacatccaggcatgtccatttatcctctgtaatcttggtggaagctcccatacctcaacccttgtcttctgcacacctgaaggcccaacaccatgtggaagccaccaaggcttggggcttgcatcctctgaagcaatggtccaagctttatcttggcccctgttagccatggctggagttggagcagctaggatgtggggtgccatgtcccagggctgcatagaacagtggggccctgggcctggcccatgaaaccattttttcctcctaggtctccaggcctgtgattggaggggctgccacaaaggtctctgaaatgccctggaggcattttccccatcgtcttggctattaacattcagctcctccttacttattctgcagccttgaattcctccccagaaaatgggtttttcttttctaccacatggtcagactgcaaattttccaaacttttgtgctgtgcttcccttttaaatataagttctagttttgggttatttcttcgtttatgcaaatgaatatatgcttttagaagcagtcaggccatatcttgaacactttgctgcttagaaatttcttctgccagatatcctaaatcatctctctcaagttcaaagtttcacagatttctagagcaagggtgcaatgccaccagtctctttgctaaagcatagcaagagtggcctttactcaagttctgaatgagttcctcatctccattcgagaccacctcagcctggatttaactatccatatcactatcagcattttggtcacaaccattcagcaagtctccaggaagttccaaactttcactaattttcctgtcttcttctgatccctccaaaactatcttaacctctgcccattacccagttccaaagtcacttccacatgttcaggtatctttaaagccatgccccacttctctgataccaattttctttattagttcattctcacattgctataaagaactacccgagactgagtagtttttaaataaaagagatttaattggctcacaactctgcaggctgtacaggaagcatggttgggggaggcctcaggagacttacaatcatggcagaatggcagaaggtgaaggggaagctggcattgtcctacattgctgaagcaggaggaagggagagtaaagggagaagtgctacacacttaaaaaaaaaaaacagatcttgtgggaacttactcactattatgagaacaacaagagggaaatccacccccatgatcaaattaccgcctaccaggccccagctctaacattcaggatcacaattcaacataagatttgggtggggtcaaagagtcaaaccatatcatacctcttggatgagaattgcacctttcatttaagttttgtcaggaaaatgatgcaatgagaataaaaaatgaaaccataaataatttttactttatgttttcttattcaagctgaccctagatttatttctcaacaactgagatagaatctttgttgatacagatgtttctaaatagaggcaaatcctttgttacaaacaggcaatgttaaggatgataatttgtaaataaactaccagaggttctatattataatattacctagtaatattatcattgatattatatgttttacagatacattaaaaaacaaataccttaacaagcttcctaaaaacctaagcataaagtttaaagttttggtgggaaaagacatttcttgtgatagtctacaataccaaaaacatcttctcacctgtgcttatctctcctttaccctgctgtcttagtccattttctgcttccataataggataccatagattaagtaatttataaagaaaaagggtttacttgactcatgattctggaggctgggaagtccaagagcatggtgccagcatctggtgaaggtcttgtgctgcatcatcccatggcagaagggtggaagggcaagcaagtgtgcaagacatagaaagaatggggcaaaacttcttgctttaataggagcccactctcatgatagccaacacattcccacaataatggaaattatctgtccatgagggcagaactctcatgacctaatcacctcttaaaggtcccactttgtaataccatcacaatggcaactaaatttcaacgtgagttttgaatttaagccatagcacctgctttctcagcttttgtaagaagaataaagagtccttctttccttttaagctaattctgatgacatattcctgcttgaaattctaataagacataaatttaggaaccaggaagtaagggttttaggggagattaaaagacttgaggtagggaaacgatataaggttttatcatttaaaaggcaggtaaatgggtgggggcaaaatgaacattaatagcattgatggaagaggcccagtaagagttgaggttatcaggtcctggggacttcaaacagtaactatggggtgagttaattttaagatatgaatagaaaataagagaaaaagtatccagtaaaaaagaagtcaatagacagcaaagaggaaatagaaaacagtttctctatattttcatttttgttttccttgtgcatttctgcatcttcccttttcattaccacagaccacaatcatgctaacactgatgaaagaggaaggtgggaaactgataaatcctccaagtgattggcagaaggaagaaaaataataaatgcacaaataaatcaaagaaagttatatattttacatttatcataggcatatggtttgtatatttttgttatagaattaatcacattgcatttattaggctttcagttagttgaactttttggatctgtgaatttatattttttaacatatctgcaaacttttaagtcattatttcttcaaatatttttccattaccaccgccatcttctagtactcaagttacactgtatgtcagactagttgatattgaaattgttccactgagacagaattcacttttttattagcctttcatttccaatattgtacttttcagctctagaaattgtatttggttcttctgaatagtttccatttatctcttcattatgttcaccttttcgttaatatgctcgagcatatttgtaatagccacttcaatgttctcatctgccaattccatcatctctgagtctttttctcttgactaatttttctcctggttaggcatcacattttctggcattttcacatgtctagtaatacttaattggctgttggaaattgcaaatattacattgttgaatgcctagattttgttttcttattttatagaatattgggttttgttctggcaggcagttaattcacatgaggattagttgggccagaccttttaaaacttgtttttaagttgtgctaggtcagatctagaatgacctacctctcagactcattgagtcctactcttaaggcttgacctttctaaggtttctgcttatgtgtgttcacataaatgcctcatgtgtgatcaatgagttcttcccactatagttagtcagaacttgagggccgactggctgtgtgaagtgtaagttattcaaggtacagcccccagtaattgttctttggccatctttgtagtcttactctacatatctgtagcttaaatattcagcaaaggacttgaggggaccccatacagatttctggaactctttctctttatgtctctcttctctcaagctctgtcccacaaatttcacttcacttccccaaacacactctatcctcatctctgcttagattctcctctctgtgctatagtctagaaagtgtctctagtggagcatacattacttgtgtcccttctcttggggatcacagcctgttcaatgtctgagagttgcttcatatgtcatttgtccagttttctggctgtttatggcaggaggaccagtctggtaccagttatactatcataactggaaaaataagtcccaccacattcatattcaaactttgtttctgtttcttttctccccgcaaggcagtgagacccttcaaggcagtgacagggactcattcatctctgcattctcagtatctaacatatgaagcatagcatatatcaggcataataaatattattgaataaaagaataattgaccattgttaaaccaatccataatacttatggtatctatatttaagtaatttacatgaatatctaagtgcttctgtaacatgtggggtttttttaagcaactgagaataatctattaaattactgaatatatgtaagctagagatcaatgctagagtcaggttagttctatgctaaccttacataacattccttgtagctgtaagatgccagtgtccagaagcaaatatcatatgtgttcaggtatctctaggacaataatgacacgttattctagaataaaaagtagcagggctgttttcagcattcagtctatgaagttgacaaatagagtatctaccttcagagatttctgcctctatgcaagcaaaagggttaaaaactttcagactatagtttcatttatgttagtcttctaaaggactacggtggcttttaatttaaatagcaagatgcattgagttggtcttttaaaagtctatgcagctatcttctaataattaaaaagtagactcacaaaataagaattacagtcagactgctgtaaactacagaaattgggaaggaaagaagtcttgcattttcacattaaaggtttctttctgaaatcttaatacaacatctgtacaagaggtttcgtataagaaatatctgcatctggaaggatgaagtcttaaaaatctatgacgcttaaaatctgcggatatgggcacatctataattagaatacctgcacttcactgtttaaagagtccctaaaattccagttacacacacacacacacacacacacacacacacacacacacacacatcactgtgtctatttcataggtcaacacagggttcacacaatattgttattatcaatcacacagtcttttaatacataatctcatttgatccacaggattcttaaaattcccttttgttcctttttgactatatttctgtttttttttccaatgaaaagaagacttttttaggttaagaactcagctgtgaatgagatgtcaactctgttggttcattcttctagttaccttcagcaagtcaccttttcatctttgttctttgattacacaacctaccaggtagaaataataatttgatctccacatgagagttaagaactcctgaaattttaagataggataacaaaaaactggtgcatatgaagagaaatttttcaaagtaatgtttgtacttgtttaaaactaagcaaaatgacatttaaagaataatgatttaagttcatggtcccaaaacgatttaaaactaaaggttttatttcactgtgtttttttccaacatttccccctttggtttacatttgccagttaagaatttaaagtgaggctttgccaaagccttaggttccacctggtttggggttgaaaccacatgaagccactgaattttgcatagtttccatttgaaatgatttatcagcttgggttctctttcagtgagagccaggtttacatgaaacttggccaagcattagatgaacctgctctgagttttgattttatatcagaccctaaaatgaggccactcaacctaattctgtctttcaaaaagctcttcttataatgtccccagagtatacatagtagttactagagactgaggcacagcaacactttctttcagtataaaatgggggaaaatttctcggctgcttggaacctattctaatttgaaaactagacagatttaatagaggttctagtgtcaagcataacactttagggaaaaatttccttagaagtctcaacaaaagggttttcaagtaaatagctcagaaagaccaggttaattcattttttcctttattttttcctttatttatgcattcattaatttaataaatatttgttgggcacctactacatgcaatgccaagccctgttctaggcatgggatacattactgcacaaaataattagagatcccaacttttgtaggtcttccattctaatagcaggagacagacaataagactaaccacaatatacgtagtatatttgtactatgaaacaaaagtagagcaaaattagagatcagggtgggttgcagtgttaaagaggatttacaaggaaagactcattgaggtggtaagatttgaacaaagacttgaaggagtgaggaagtagcaaccagatcttgacgaagaatgttctagacagagagaacagctagagcaaaagccccaagaggaaagtgtacctatatattacaggaaccacaagggactattatgtcagaaatggaatgagcaaatgggagagtggtaggaaatgaagtcaggcaagtcacaataggctaacacattacctggaggccatgggaaggattttggctatttctccagatgaaaaggaagccacggcaggattttgtacaaaggaaacatacattccaacttacaagaatatataagttcaaaaggctctatctatcatgttgtgggtagatgatagatgggccaaggtaaaaaaaaaaaaaaaagaaacagtaagaggccattgaaaaagatgagtgctttagatttggtgatagcaatagaagtagcaaaagtagtcagatgctagctatttttttgaagatagagccaacagtattgcctaatcaactagatattaaaaagagagaaagaaaggaagacagagagagagacagggagagagagagatggatcatggacgatttttttttttttgagacagcatcttgctctgttgcccaggctggagtgcagtggaatgatctcagctcactgcaacctccacctcctgggttcaaacaattctcctgcctcagcctcctgagtagctgggactacaggtgcccaccaccacacccggctactttttgtatttttagtagagatggggtttcaccatgttgaccaggctgaactcctgacctcaagtgatccacccgcctcagcctcccaaagtgctggaattacaggcatgagccaccgtgctcagccaaagacgaattcaagatgctgtcccaagcaactgaaaggacagagctgccatcaacagagattagaaaggctgcagttgaaagagtgttggggagatagataaagagttcagtttcggaagttgagtttgagatgtctgttagaccttccagtggaaatatcattaattaggcagttagcttgatgagagcctatatttggaaataaagttttgcatttagaagtcattagcataatgtcaacaagtatgtgagtatagacagggaaaagcactaaagtctaaccgccgaaatactccagcattcaaaagtcaaagagaagaggagagaagagctccagtaaagtaggatgaagacaaatgggtggaggagttttgggtgccttggaagccgaatgaagacagtgtttcaaggaggagaatgttatcaactgcatgtggcagtatgatgaggattgaaaactgatcattggatttatccattggaggtcatcggtgacatgtataaaagcaacaatggtgaagtagagagagagaaagcctgattatttaggcaaagataaaatggaagaagaaaaaaacaagaaatatgacaactctttcagggagtttgctgcaaatggagcagagagaaggacagtagctgataagagaagcacagtaaaatatgtgtttaaataatggaagacataaccacctgtttatatggtaacacgagtgatataattttgaggagaagcatgatcatctgggtaaaaaagaagagtattgctggagctgtggttctgaatagatgagaagaggtagaatctggcccatgggtagaagaatcagcttcagacagagagaatatgcagaacctatctactccgatagaagaacatacgtgtagtggagtagatgctggcgggtgaacaagttgaggagttggggagacctgtggaagttctcctccagttgcttctatttccccagtgaagtataaaccaaggttatgagtgaaggtcagggaagagtatgaggagggatgaggtggtgtgaaacagatatttgagagaatggaagagtcgtgggattagggcaataaagtatgtttgcgaggcagtattaggacctctttgaagttcatggcactgaacataacatgagaccatttaggggattctatgttcttctccaggcacatagagttgcacaggtgcagatacggagcagccagagagctggatttaactcaagtttggggaaaccaagcaaggatggtgaagtgagagagggggaaggaggttgagaatgtttacaaaggactgatgataatgactgtcggtggaattataattcactaccctcccctgataaggaggggaattaagacatcaggggccggtgaaggagtgggaggatcaaggattgaagagccctgccttgtcaaaggattgttggggttggcatactaagagcaatgatcagagagtgggatgcatggaaccaagatgatggagcgggcagttaccagtactcataagggctagggttgattagattggccagggagtggcttggggagaggaggggtgatccagaaaggaagaggcaattgtgttcatgagctcacatccaagagctttgaaatcttcaaaaattcagacaggaagaaatgacagcgaagcaggagctgaaatcatttagaaattaggaacaacgtcctagggtcagtcaataactagggaagtagtaggctatgtaatatgataagattagagataagaaagctaagagatttgaggtggacaatagagagcatggagggagggagaaagggacagagaagaaaagcaggccggcaggctttaagaaagattttggcatgacactgattcaacggtatgttcatccattcttgccttgctataaagaaatacctgaggctgggtaagttataaagtaaagaggttcaattggcttacatttcctcaagcagtacaggaaacatggtgctggcatatacttctggtgaggcttacagtcatggcggaaagcaaagagggagcaagcagttcacatggtgagagaggaagcaagagagtgagcggtgaggtgccgtgctcttttcaatgaccaggtcttgcatgaactcaaagcaagaactcactcattcccatgaggatggcaccaagtattcatgagggatctgcccccatgatctaatcccctccaccatgccccacctccaacacagaatcacatttcaacatgagacttggagggagcaaaaatccaaactacatcaaatggatacactcacatttgcattgaatatcctagagttatgttattcaaagatagtatagttatagacaaacctgaataaatcattgcattttgtataaagttacagtttgccaaaatgagattcttcctccatcagaaagtatcaaggggccaataacatgctgcttcttttttttatagtgaaataaacaagaaaatccttagaaaggtgccaaatgatactgcagaaaaaggaatccaatttacacgtagatggtctaggcttactttatgacaataataaagcaagtattttctctaggaaagagagcttaaatctctgaagggcagtggatagctttataacgtataatactggctttattacccttttatggttttgcatcttctctttactttgacaaaagatcattcagaagtgaacttacttcaatgatacctgcacagactttatgcctacaaaagtaattcatagtatttatcctggtgacaggtcagaggagatgatcaaatttttttattttccctagttaagctatatttcattcttgatgccagagaagttttttttaatttcctgggaatcaggaatggcacttttggcaggttctgcaccaatctgagctcacagatgcccagaaattgctcaatggtactaagtctcctaagtaattccaattttgtagtgaaacaaattctattttcttttggaataaaatagagaaacagggccaggtagaatttccctggagtaagtttccttttcgtgtttatgaattatgtctttgcccatggtgagcagtggcaaggatgacagcaggtggctcattttacaaatcagtaaaccagaggaaaccttggtttgcaaggaagttgagtggggagaaagaatattcaaaaggaaaagaatattaagtagaggatttcaaggaattaagttcttgctcgttctttactacaaatagcaatataataaaaattgcaataaacctcccaggcacctaactctatgcagagtggatttcgtggacttcatctgaaatgacaaatctcaataattaattcaacaaatttcaatgcatgccttacatgtgcaggatattgtctaggcactgagactttaatggtgggatgtggcccacaggttccactctcagggagcttacattctcagatgaccacaatctgcccccgtgtgagccgaagttgtgactgcaagtgacaggcactgaaattcctggtgtgataatcggagactgcctctttagaggttgttggaggagggatgaagcgtctttagcacttggaacaaatttcttgaagctctttggtgtagtaacaccctagctctattctttggataggttttacacaaatttgagaatataatatattctctgaaaatgattagaagttaataatgaaaatgtgcaggatcctaagcagaattgtaaagtttggaaatataaattgctcataaccaaatacctggcttctgcaagaccgtgccagcttaaggacactttgtaccatagaagtatatctcaggaaccttctcactgaccagcatcttgagttcaacgaaacccctctcctatccagtcacagagctcttcttcagtttcctgtaaagataaaggacttctcccaaggccgttagctgtgtcttgatgcaaaagagaatttaaatttaaattctttttatttaaataaagatcattctattcttacattttcttttattagtcaatctgttcaaatgactgactttttattttattagtcaatttttaaaaaatcttccatttcaaaatatttgtctcctaaagcttatagaaaaaggcaggccaggcatagtagctcatgcctataatcccagcactttgggagcccaaggtaggaggattacttaagcccaagaattcgagaccagcctaggcaacatagtgagacagtatctctaccaaaaaaaaaaaaaaagaaagaaagaaagaaagaaaagaaaaattagtcaggcatagtggcatgtgcctgtagtcccagctacttgggaggctgagatgggaggatcgcttgagcccaggaggttgaggctgcaaagagctttgtttacactactgtactctggcatggaagacagagtgagaccctgtgtcaagaaagaaaggaaggaaggaaggaaggaaggaaggaaggaaggaaggaagggaggaaggaaggaaggaaagaaggaggaagggaagggaagggaagaaaggaaggaagaggctacttgagtttcactcgggttacaggattggcttcaagagaaagatagaaaaaataataatagactcttgtaagtgtctgaaagagagaattaatccaaaagtactttaaacactctagaaatgcaaataataaaatgtcggtgtgaacagttcttgtttggctttggctggtatctttttcttaagcactcccttccggtttgctgatagctctctatctgctttgcctaggatgacatccaaggcaggcagagtatacaaggactcttcaggacagataattgcatgtgcaaaagtagcttggattcagagcttcattttaacggttcgtaaccatattatcaatctgtaaaccgcatagaaacaaaagatgtcaagagaaaataacaggaaaaaaataacactagcagacagattcctccctacaaagtcttgtagtagaaaccaaaataatacaaaaacctgacaatagccatgtcattgggggcaagcggaaagacaaggtaaatgaccagtagagccagaggaaagaactagaggtcaggaagcacaaagggctctgcagagaggacgaaagacttcattccagatgctcaaagacagaggatggtggtgtcagcgggggattcctgggcagcttagggactaagcaagcacagggctttggtttacttaaaataccagttatgcgaaaaacagaattgcaggtgtctccacaggatgtatttctgcacaggttcctaagtaaatatagaggacagatagatagagtgaacaaaaaataaacaacccttatccatacagacttaaaggcttaaaaatgaatgagattttcattgtgtggtttctacccatttagtgtgggcaagtgtgtatgtgtgtgtgtgtttctttttctttagaattgcagggaaaatgcatgatgaaaaatgatgtttaaataaccaaattcctatgtgtttcactggctgagagcagagagacaaggagggaggaaatgagaaggagggaatctgtgaagagtttgactaaaaattgtcctcttccctcctccaatataatgcatcaaactaaaagaccagtttggagaggataaagtttaggttaaaaatgtgctatatgcagcccgtttctttctttcccaggaactcttttatgtccaactgcacagtctctatcttcctctaatccttttcagtctccttgccctttgcccccacaggacctttggcacattgcctcttgacctcaaaaaatgaggagttcagagtttcagggagattttgatgaaaccacctgctgttcttctctaccattttccccaccactgaattcaaatagaacggtagagggtataaatatgctaatattctgaaccacaccaaatccccaactcagcaattcctgtgagataggacagttgtagggatgggtttgagttaataattctcccaccactacccaaataggaatgggattggaagagcttgtagacagacgtggattccaatctctctcatatggaaaaagtgcaaaaatccaaattctcaaaagattagtcgacttagtattgtgctttgtagtcgagacacctcttgattttctcttacaaaacttggttttctttaattatgtactggtaaactctgaccagaaaactggaatattttgttatctaaaatttcgcttttataaatccaacttttggacatacaactcttagaagaaagggtcataccagtgtgtcctgagatagggcatcatttagcttggggaatgaaataagacaagcacagcatggcatttaagccattagtcctgatgagacatattcacagttggtcaaagcagggaagaaagcaggcaagatagctgaggaaccacagtgggtttgttgttgttgttgttgttgttgtttcaggtagtagttccctgtctgttttaggtttcaaatttaatttggaaaatgttttagttgactaaataaaagacacatgaattcacggatcatagaaaaagaaggaactatagcagagttaaaatgtttgggttgtgaaaataaattagtaatgaaaaaggaaatgcttattaggaactttctatgtaccagctcttctcctaagtgtattacatatacaaagttatttaaacctcaaaaagtctgtgaggttgatactcttactccagctttactaataaggaaactgagatccggaaagtttaacctgtgccaggtgtcacagctagcaaaggggcagagctcccgtcagaccccaaagcctgtgtttattgtaaaaccattatgctaggtgccaaaacaatgcttggatatatgaaagggaaaagaggtgatgttcttctaagaaagccattaggaaattcctttgaactatcactgatgtagctcctaaatttcagaacccctctactctctattcttatgaatcatcaacggttagcactacgttgatgctctaactacgacctctaactacgaaactgaatcgcaccttcagttgtttatgacattgctcttttttagaaacttattgtattaattatctattgttgcattttaagaaaacaaaatgtaagagacttaataataaacatcaatgctcttacacagcttctgtgaatcaggaatgtgggagcggcttggctggatggttccagtttaaaatcttttatgaggttgcagcctaagatacagagcagaccctacattgttctaagggacttactagagtaggaggatcctctcccaagatggctcactcacaaggctggcaggttggtgctggctgctaattggaggcctcaattccttgccatgtggacctctccatggggctgcttgagtgtcctcaccacatgcatggaaactgagagcaggtgatctgagagaacaaggcagaagctgcaaagtttattaggatctagcctcagaaatcacattctgtcattctgtaatcccattggttacccaggtcagccatattcagtgtgggagggagctgcacaaaggtttggataccaggaggcgagagtcactggagactgtgttggaggctgactaccacacttactgtcagtttattaatgatcctatttggtgactcggtctcatttttctgctttagggcaagaccaacagagagatgaaataaatgcagtaaatgcattcagttataattgcagtggacaatctgcccttgcatcttcccaggagagctagcgcttgaggagtctttctggactctcaactccggtcattctattgccctactgcttgcatcaaatgtaggatttgtcactaaacgtcaggctcaccaggatagtcaaacatcaggctctttgagcaaaaagaaaaagtaatgtctagggctaccctacatattcattcagttatctgaaaaatattttttagatgcctactgatggatagagccattgtctatgtggaatcttaggcataatgtaccattaggagggctcagtctgctaattgtagagattctttgctgaaatgaactttagagatagttaaatatagtcaccactccttattacaaataaaaacattgaagtcctcagaaaactaaaacttgcttttgttacttggttatgcctgttctgctttgacttctctcatcgataaaatcaccatcaaaaccactgcctaaaatgggttttagaggttctctctggatttcattgcttttcctctaccgtagtaaccagatgaactatttgaatgaattgtacctctttccagagttcagtccaagagtcataagttgtttatggacatcactctggtccttctgtcttagaaagaggaaaatctaactaaacctcaatactagcattgacctataactaagtaaccactttctatctggttagccaacatgtcaagttagacaactgtcctttccaaagggattgaagctgttggtgtcctgcacaagtggatgctgagaaggggtagaatggaatgaggtaaacaggtacttattgaggacctactgtactccagacagaatgctagcactttcacacctgggccaaccctttaatttccaaaacgatggcatgaggtgggaggcatgatgattatcccattttacaaaagagaaaactgagggtgatttgtccaagaatggttggggatcaagagacatatttgggatgtaaatccagatctgcctgagcctgtattctgacccactaagctgcccaaacaccactctgaactgacttctcagtgaacatgcctagctcatgcctgtgctctgtctcctctcattgtcccttgttgctttggaacactgaggtttaaaaactcttttagctttatgtttgcatatatgtgtatatgtgtaaatgaacagttttcaaatacattgttatctccttaataacagtatcccttttaaatttccccttccccacccatagggtggagtactatgctctgcccacaatgagctctgaagatagtttttgttcttgtgacagattttcaaccaagccaccacccacctctcctccacctcaactcactaagtgttctcttctgctggtggagaaaaaaataaatcatttcgaattttttaatatcatgttatttccctccaaacatgtatatattgtgcttctgcaaaaagtctttcttaaccagtcaatacatttgtctgctttagagttgtgatgacagtaattaatgtggaagctgaaaagtcagatttattatgactgagagaagtctctgcggataacctgtgtcttcacttaatttcaccacagaagtatttttttattctggaaatgttttttaaatgtaagcacattataatcgatgctgcttctttgtctttctctggaatttccaagacgaccttttcctctttgtttctgcttgtagtggctccacagctcagtatcaacacgggaaagagaggcggctctaagctgattacatacgcggccacccctctaagggcgaaactgcattgctgtcagtcttaggaattcacaaccttaacagcagccatggctcttcagcagaagccctgaggctcagttgccagctgatgacctttgatgggataatttctagctttgctaagactgcaagaggaacaagtgaggggttaggaagcaagagttattcatgaagccactgtgtctttattcaagaacgttgagaaacaaaccttcatggctattcttcgttaaataaagtagcatacccatttaaatttcaaaattgttcaagtcactcataaatcctcgaactttatctttttcatttaaaaatccttttttgcctgatggtcttgtaaggaaacaagtcattctatgtcttaaaatgattgtttcaagccaaaataggcacatgagaacattttaaacttcattgaacctcgaaagaattttcaatatttgaggagagaacccttcaattcttttttttttaaaggaactggacaacaatatgaatgtaatagatccattagcattgtgagaaacaggtcactaaccccccttttcattcccacaacaccaccaaatacttttctggttttaataactgttagaaaggtctgctcaaacacagaaaggagctagtgttttcacaagcctctgaaagaagaggatgcattgcaagatctttaaattcattgtacagcaagagaatgaaaaagaatgtaagaggaaagtggacaactacctgtttgacctatacatataatagatttgttactaattagaatcagtttgttttttgttgttgtttttaccatcttgaactttattaggtttatgattgtgcaatagatctctagaactcttttatcttgcaaaactggaactccacattcattgaacagcaactccgccctttccctcccatccttctctccctcctggagtccctggcaaccaccaattttactttctttcctatgaatttgactattctaggtatctcatataagtgaaatcatacagtaaaattattagaaccaatttggatacaaataagatttagatgtacaaattgactaatctggatgtactaatatcaagacaaacaaatgaaaaccaagtatggccacatgatcaagaacacttgcttggctcttattgcctctaatagttttctgtatgctcacttttgtgcaaaagctgtttaaaatccagcttaccgatacctattatcccagcaaggacagggttgtgttgggcagtggaaaatggtaaaacctaactctgaaggcccttggaccatttgttccaaaagcaaacaagttggaaagaatgtgagttttttatattttattttaagttccagggtacatgtgcaggacgtgcaggtttgttacacaggtacacatgtgccatggtggtttactgcacctatcctcaataacttaggtattaagccctgcaatgcattagctatttatcctgatgttctccctccctccgtccccctcccccagtgggccctggtgtgtgttgttccccttcctgtgtccacgtgttctcattgttcagctcccacttataagtgagaacatgtggtatttggttttctgttcctgcattagtttgctgaggataatggcttccagctccatccgtgtccctgcaaaggacgtgatctcattccgttttatggctgcatagtattccatggtgtatatgtaccatattttctttatccagtctatcattgatgggcatttgggtcgattccatgtttttgctattgtaaatagtgctgcaataaacatactcgtgtatgtatctattgtagatagaatgatttatattcctttgggtatataccccgtaatgggattgttggatcaaatggtatttctggttctagaactctgaggaatcaaaatgtggttacttttttacctccgatctgtctttattgtaatattaaaatcaaagacttgtagagaatagcctaaaatcccttaaacaaagttaaaaggcaaataatagtctagaaaaaaaatttgcaatgttcagtgctaaagtcaactatttttcctggcttaagggagttttattcttagcagttatgataatgacaaaaaacatgatatggaatgggaatgagaaggaagctgtcaatggtttgggaaaatattttgctaatgacttcattgagagtaacataatggaagttcatcctgggggctgagtactgtacattctgcattactgaaccctgaagtttgcttaccgaaaatacttgcaggaagtagctactaattaaataggcattctccaagaattggatgaaaattgaaaaattcagaaagcatttacaaataatttgtttaaatgtctttaatataatattacatctttatagtcaaatagttctttaagaaattctttcattaagatcactacattgtgcatggtggatatttttctgggtgagttagtattaactccgtctttaagagaattatttatatatcataagaaacaagaatcttatagtgcatttgaagaggccaactctgaagaattaggctacatttttagaaacatcaccaatcactgaagttttagaatatataagaacaagtattccttccaggaaggtaggaatattacatttcttctacttacatgttttattaccaattcacacttaacattggtgaagtaagcatgatctttcatgtatcacagacttcatttccttgacaaacgacttaattataatactttattccaccactttttttgagacaagatagcagtatttgaaggcaatttgagaagttggcaagcttacaaatttatgagcttatgaaatttatgtgttacattgatacaactgacgtcatacatattttataagaactgccctaaacatagacgtcatcattcataatgaattaatacttaaaggaaatttaaaaaaaaaaaattcagctaagagagtactgttttgatatgaaataatataagactttataaggattgttgtttaaaaacaagcaagttgtttttaaaattagaattttgcatgatatatcaattagaatgctttgggttgaaatagaaacttcagcctaaactgtcctaggcaagcaacaagacaatgtctgggctcacaaatgataattccagagaataaggaaagcatgctgcagttggggctgtactggagctccattaaggtcacctgttctgtttccttccctatctcgcttggctttgcctgctgtggagagctccatatttaggcatgtttaggcccttgtgtttacaatgtggctgctccagctccagcttcacatcttcacagcctgaagtcaatagacaacagagcactgacttcctccactgctcaaacaacaaaacctctgaagtgagtctcactggccctgagtgacctggcgttgggcattgatcagcctttaaaacaatcactcttgctgaagggaacagaagagaggtgcactccagacagtgtgctctatgggagagaggaggaggtgcaactattcctggaagtacaagggatagcaaagaggaaaaattatttcctcaaaacaaaatcagggacagttacaagaatagggtgcagctcctggaaaggaaaaaggcaaatagggcctctagcgttaggatgtaaggagtaaagctctaaccttttttctggattaatataaaatcttagataagatgagggtgccaactaaggagagccagtggggagcaggtattagaaaatgtatgccacctaccaaggaacaacacaaccaccctcatccaaagcaaagccataagaggccgggtgagatggttcacgcctgtaatcccagcactttgggaagccgaggcgggcagatcaccaggtcaggagtttgagaccagcctgtccaacatagtgaaatcccatctctactgaaaatacaaaaaaattagccaggcctgtaatcccagctactcaggagactgaggcaggagaattgtttgaacccaggaggcagaggttgcagtgagccgagattgtaccattgcactccagccccagcaaaaatacgagactccgactcaaaaaaaaaaagccataaaatccctgcaagcaatcaccagcacctcactctttttcatggtgaatgtcacttagatagtagaaacttcgatcaatttaatttgatcatgtactctttatagtatttacgctcaggtgttttgcgcagatcatttcactagtcttcatggtattgctggttaacaataccacccattgtctgtttggtgtcagtgaaggcttgtgtacctgcttacatgtgtaaattcacctggcagctcctaagaagggcttgtctagttcttattcaaacaatgtgtaaaggatcagaaagtaaatgttgttccctttcatcaaacatgccacagaaattaattttgtttatattttgtgtaaactccatgatcctgagtatcattagcaagttaaatcaaaaatagctgatatcttaccactactactatatatcagaagacatttgggctttctttgcagcctgttgtttgtgtttattaacatctttgattggcaagacattctgcttctaggtacatttggttggagggatggtcagagtgtaatctattagccacatttcccaggctaaagtgggctgcattttaaaataatcacttaacaaacataaaattactaaggatggagccccgaagcacagacacctaagaatattttcctttttcgaggaatccttggtatgttgattcactaatttctactcacttagagcaatgtggtagacatagctgctattttttaggccaatgtgtcgaactcacactctcataagcaagacatggagtggtaactgccaggaagtctggtgagatcatcgaaagccatgttcctgctctttatggccctcccagggaggaagggtggtgtcctgcagaaggacccaggcgcttgactgcctgagttaaatgccagtcccctacctactagttgtaaccttggaaaagctattcaacctctgtactatgatgacttcagctaaaatgggggaatgagtcctacctcctccgttttgtaggcacttaatgcatggttcctggcttatactctgtgcccagcaaacgtaagcttctatcattagcacctctgactcactgcacagcattaggagactctgtgccctggggagagagtgaaaccctccagctgggctttcagaacactctatttgtctctgctggtggaaggagattagctagcaaagggatttctgggcatccctgacagcatctggtacacagtagggcctcttagaggtttgttgaatgaatgccaggaccctggctgaaaggtgcttctcatccccaaggtatcaggcactttaagaatagtttcatacatttctttttaataacctcaaccttgtcttctatgaaatagagttcgattgccagaaactgtcattaaatatgcatgactctgttaagagattttttttgaacagcttttggtttccaagagtataccatattaaatagatataaaaattcttaattctaccctcagcatgagtgtgggcatcttaggggtaccccaagaatgtgaatcattcaaggggattcgtcctcatgactaagccatcttctgacactaaagttcaggtgtttaccatttttaccacaaagggggaaacagcctgcagaaacagttactatcctgccatatgtcaggggacactgaggctaatatctgcacgtttggaatgagagtgtgtgacatgcagtgctttgcacaatacaggatgacggcaacttttgactttcaacttctcgctttcttcactcattttcaaattcctcagagactgtcttttcagggcccttttaactgtgtgtctggaactgaaacagaagaaaaagagaaaacagaaaaataaaaatagaatagaaaattgaaaaaaaagtaattttctcaagttttataacatttcaaatcctttttttttttttttagacggagtctcgctctttcacccaggctgtcgtgcagtggcgccatctcggctcactgcaggctccgccccccggggttcacgccattcccctgcctcagcctcccgcgtagctgggactacaggcaccagccacctcgccctgctaattttttgtacttttagtagagacggggtttcaccgtgttagccaggatgtcaaatacttttatacttttttatatgtatacttttttttcaaggaaaaagcctgctttttgttttgtttgcttattggtttttacatttctgttgcctttttttttttttgagccattaagctcttgctcagacacatgcttctcatcccgtccttctatgcaatgccatgaacattaaacccttcagcagccgcgttcatttgcctgcagtcagtgactatcaatttggcttgagatttctaggttaagtgcagtaatgcactaaggccgggcccctttctggagataccagcctccaggagtctgccccaggtagtccagaagttgagttggtctgaaagcacctgtctggaaggcgagggggagtacttgctaatggtatggagaggtgcttggaaacaaagtgcagggcaaaaattagaccatgagagaaagtagaaagtcctgtcatgtcaaaccttccaacactatagtcttttttctttttgcaaagtttagcttattttcttttttctttttttttgtttttttgagacggagtctccctctgtcacccaggctgaagtgcaatggtgcaatcttggctcactacaacctcctcctcccagattcaagcaattctcctacctcagcctcccgagtagctgggattacaggtgcctgccaccatgcctggctaatttttgtatttttagtggagatggggtttcaccatgttggccaagctggtctcgaactgctgaccttgtgatctgccggcttcggcctcccaaagtgctgggattgcaggcgtaagctaccgtgcccagcctaactcattttcaaaacaaagtgatatatgccaggattgaaccctgtagctggatcccgtctagtgtccagggctgcctttgaaaggacagcagaggtccatctgccagtgaattcttcccactgctcagacactcgcctttgtcattcgacctgctgataggctgagggggctgcctctgagtggaaataccttagccattgttcttggaaagaacaacttaaaagctgagaaatggcttttagactgattgggaataaagttggacttccacaactttttacttttttttagtctaccgaataaaaatgatctttttgagaaaccagggctctgtgaaaaaggaaagtcttttaaagatgaaagatctcatgttatttgaaaaagacatttagatgtcctaatatttctcagattatactatgatgtgcaaatatgaaaagatcttgcgcttggcaattgctaactagatatgtagatatgactgcaaacaccaagggatgaggtagccagttcattttattaaatattttacatttgagttgaagaaatacccatagaagagaacattagcatctagacatccattcttctattccaaagtcaatgactaagcccctatgatgtaccaaattccaggtggcctctagagggaaaataactgtccgatatgcgcagggcattcctcgagtctcggggagggacagggaatttctacgatttctacggaagagaagtaagtgtgttcatggcagtgggagttgaagggaggcttcactgaggtctgaactttcttagggtataaaaatggtgtaaccattttggtggaagtggagttggttgggcagacagctgcaggttcatgagcccacaggtgtttttaataacagggctgttgtggggaacagggaaaagacatggttaggccagcatctaagaagattggtctggtacctgggtgaatttaagggtaatttcaggattaacagacagaaggcaaaaagaccattagaagccattacagtgatctggaaaagtaattataaaggcatgaactgtggtagtgatgaaagcaatggagaaaaggagacagaatcgagaagtattttgatgataaaatcagcaggataggggattaatcagatctcatgagtggagaaagtactgggataaatggaaagagaggatacatatggccaccagattcatctctctattcataaaacgatggttgtgccactgaatgagataaagacactaataagaccctaagtcacttttctttctaacacaatgacacggattattttctacaaatagagaacaaaatactagagtatctaatatttgtaaggcacttttgcatttataaaatgtttcactcattgtaagtcatttggtataattacaatgctgaaagacaggcagggctattatattttatggacgagaaattatgtttcacagaggacatctacttctcaaagtcacacagctagtaagtgggagagcagaaactcagattcagaactcccttccaaatccatccctccttccctgtagcaaggccagttcttttggtgaggagccatctccctgccaggacagagacaagctgtttctgccttggtgacagcgtttcctgccttcttgcccgggtttctgtaactagcactgtgcattggtgaccatggtcaggagtggatgttcttgctgtaggatcatattttagggctccacttgagatacatatgtgttataccttctttttcctcttgccacataaaatccacaaatggaaggccgatgaaaagtccctggagcaaatgtactctttgtaattttcacaagacctgtcaaattctagatgactgcaggcatttcattaaatgaagtcagtagggacttactaatgcctctgttaacttcactctaaactaacccaaattaacctggatctcaaaaatctggggtttcaataagaatttctaatcttgaaagcttatagcctttcctatatggcacagctgaaagattcctgaaaacagaaatttaggaaaagggaaagaaacaagcagaacataagtgtgggtttgggagaagcatgatggagaatggtggagcaggaaggtggtgggatttacagggaagaaaggataatgtctccaggcctatatattaatttcccactaaattcaatcagatgtcacagatggcatccacattacacagaaatatgaggttaaagcaaattgatatggaatggccctgcttgtgagaccggaggacaccccaactagtcttaacctaggcaaaggcaacatggcacttcccctgagaagtatgatggcaggtaagcctgccagtgtcgctgaaggaacatgaaagagcatctaactcccatctgtggcacagctaaaagattcagaaaaaccgaggcagtggaaatagtgaaatgcattctcacatttcatccccttgggtttaccctagcatatgatttgaggatgagggactgtaacaaatgcatcatatgtgaaagagaaggaagagaaagtagaaacgaaagacgtctgcttctaacagtgacatttttaaagcaagcacagtaatctctgaacatgtatttgaaagtacagatttcttgttcaaatagggtaccacagaaacacagaaccctaaaatgctcacaggtagaaaagctcaggaagaatgtctttgttttcaaatatttgttagggacaggaagccattaaataagatatgtgggtattgttagtgtatgacatatgggtaaataatgatgtttgttttctagagtggttactacaaaacttaacttcttaattaaaaaaaggaataaagatggaaatggtttaagctcagaactgtgaaggcaccaatttgtagatcactgaaaatatttgatcttccattctttctcaacacttcatccaagctattgatgggaaggaactggagagggagtggaagaggaatatgaggaaggtgtgtccttacttaaacttgaggcttactgacctggaattatacattttctttacagcgctgtcattcatttaaaggtctggaggataggcatgtcccctaacaccttcttcccagagagctggtgacatacagttatattccattcttcttcccataccttcctcattgacataacttctggaggtcactactgtaagaccttgagagttctgcatatgctgaagaatattggggagggcttcacagtgtttaaatatgtggttatgatggaagcagaagacatttcttcacaacatatgcaacttactcatctgagaaaattccttaacccgagacagaactggcttcagtgaaaatattcacagaacatgaaggaaactgctttgcatcaagtgcaatgtgtgtccccagtgtggtcatgatggagtgttctgtggtgtagcagaaaggtacgagatatggcttccttctccactttgagaaacagtgatttgggcttagccatttcacctctccgaatctgttttgacccccgagaaatggggataccaacagtgctgccgagagttactggaggatccaaattagaacaagtatgtgaaacctttgtacagtgtaagtttgatacaaatgatattatcaattacttgaggcctcagcatcctcaattttaaaataagttgaatacgatgacttctgaagtccattcgtgattcctgaaaacagaaatttaggaaaagggaaagaaatgagcagaatgtaagtgtgggtttgggagaagcgtgatagaaaatgacggagcaggagtgaagaggaaggtggtgaaattaacagggaagagaggataatgtctccaggtctatatattaatttcccatgaaattcaatcaaatgtcatagatggcatccacattacacagaataatgggggtaaagcaaattaatatgaaatggccccgcttgtgagaccagaggacaccccaactagtcttaacctaggcaaaaacaacatgggacttactatgacacgcatgacaaacttctatgagtctgtggttctgtgagatagagatttagcaaccatccaattaatgcttcttattgatcaaatcagactatttgtttttttaattactctaaaaacaccactgtatacattccatacttgcaaatatataaattaagcccctggttttgtttttgttgttgttgttgttgtttatttcttttaaattccagggtacacgtgcaagatatgcaggtttgttacataggtaaacctgtgccatggtggtttgctgcacctatcatccatcaccgaggcattaaacccagcatgcattggctattttccctaatgctctccccaacccccaccctcccctcacagaccttagtgtgtgctgtttccctccctgtatccatgtgttctcattgctcagctcccacttataagtgagaacatgcagtgttttgttttctgttcctgcattagtttgctgaggataatggtttccagcttcatccatgtccctgcaaaggacatgatcttgttcttttttatggctgcgtagtattccacaatgtatatgtaccacatttcctttatccagtctatcactgatgggcatttgggttgattccatgtctttagaagcccctgatttttttaatcatctgtgttcaatacctttacatcttttttttgacaaatagccacatcatttaggaatccttatagcccaattgattctctagactgtagcatcctagcatcactctgtgttggcagtgggccacaaatggatgacagatgtgtcaagatgtgaactacaggtgtaccaagatatctacctgctcagcctcaggatggctgggcagttctgggatggccagagccccttggactgtgagtggcctcatctgcttatcccagtgtgctgtatataatcaatgtcagtattttccatgacaggaaacactttgaggatcatagtctaaactaatcaagtttatcaaattatattcatttcatggtagttatgcataaatcaaattggctaaggtgtttcgatttacacattcatgtttctctttctaaactttgctagtttattaataactttagagtttagtaattactataaaatcagtttcacaagtctaagaatagtgtgttgtaatgtattaatttgagtttttggaatcctaatttgaggtataactgagacatttatacaaaacaaatgtttttttttgtttgtttttttgtttgtttttttttgagatggagtctcgttctgtcacccaggttggagtacagtgccacgatctcggctcactacaacctctacctcccgggttcaggcgattctcctacctcagcctcctgagtagctgggattacaggcatgcgccaccacagctggctaatttttgtatttttagtagagatggagtttcaccatgttggtcaggctggtctcaaactcctgatctcctgatcctcctgcctcagcctccaaaagtgctgggattataggggtgagccaccacacctggcccaacaaatcactttttaaaattcctttaaagcatagaaaccttgtttctttaaaaaatccttgctattcagtgaaggcagaattcctattttcaactgaaaataaaagtcctatttgcatgagtgagaaaggaaatggggaaaatgcctgcagatgaagacagataatcaagtttttcttatgaatagacatgtgccaacattcctgtggagttgtttttagtatcatctttgtatccaacttacaattttacatttaggtaagaaaatatagaatatttttagcaatattttctgaaaatactgaaattcttcttttggatataaaatatgaaaatccatcatttgggggttaccacttaacctctttcaggaaaactcaggtagagtccaggtagattgcatgtgtgaagattctaggcttttcattgttgttgttttttaaagaagctaaagagcaattcatggcataataaaatatacttgaatcctaaaaaattataaaaagataaaggaattctttttttttttttttcatttctatggctcatgagagattcctaatattctttatttgacccagaaaccttaaactgcctaaaatattagttgagtttggagtataatgtctgttaagagaatttcttgttcccacttacctctatcaatttcatagcacttaccatatgttattgtttgtcctatttcaaatataaaccaaactcttctggtctgacgttaaaggccgtgttgtcctaacattttaaatctagaatggttgtagaatgagaaaaaacagtagggttagttaggagatataattgggtatttgactacacatagcaaaaaccaaaatagggccttattgactaaaggttttattctctcaagtaaggaaaattcagagtcagggcatcaagactggaacattagccactagggacctgagcttcttttctctctttactacatgatggagcattccatctgtgagaacttctcgtggtccaagatggctgcagaaacgccagtcatgacatgtgacaaatggacacccacactcttttatttcttttgtctttggttttttgggtttttttgttttgttttgttttgttttttggtttgtttgtttttgttttttctttgagacagagtttcgctcttttcgcccaggctggagtgcaatggcacaatcttggctcactgcaacctccaccttccaggttcaagcaattctcctgccgcagtccacgcccagctgatgttttcttttgttttgttttgttatgttttgtttggtctttttagtagagacagggtttcatcatgttggccaggctggtctccaactcctgacctcaggtgatccgcccacctcggcctcccaaagtgctgagattacaggcgtgagccaccatgtccagcctccacactgttttatagaactgtcccacacaatcctttcattacgtgtcactggaaagaaatcaaccttgtgggcacatagagttgctagggcaactaagaaatatcacctatagctggccactgcaaataaaattgggatcttgttctaaataaagaagacaatgaatgatgaggtaggcaattagcaatttgcatcacatcatttaggactctacaacagcaaaaaaatgaaaatgtaattgttttcaagaaatggtaacagaaatgagatgagttcacagtatggagaaaatagactgctgctatcagacaaaataaagttgtgccttatcattattgtatggaaaactattttgtcctctacatttatccccgtggtcaggcaaagctatgattcaagctgaggtgaatttccaggaatgcagcacattctgctgccctctccccgtgagtcctacctagaaaattacaagctttccagctgctgtccacaggaaagatgctaaattcccataaagcagtccttttctatttaaaattttgcgtttcatgtcaagcacaaatgcattttcagtagtataatcaatctaacttcctaatctgtttttgtaaaaagactttaaaatgttaaaatcaacgtatcttcaaggctttccttaaattattaatccttgagtgatttactctgagctattttgtagacatattgttaccaaaatcttgttcttcacatactcttttaaaacataagagtctattaagagtactctgagcaacatcataatgttgctaaaattattaggaagcagcattaacactttaactcactatattctcattactcgggaagtcattacctctttgtatttttactggttggtgggtttgtgcagaaagaataagtaaacctgaaaccaatattctagttgtgtgagttttgtgaaaagtagcaatgaaaaggtttgaaaccagtgcagacacagctttcctttgcttgtctgtacattatattagcttatatatttttgccatctatatccatgaatgatcaagttgacaattataaaacaacaagataaaaatggaaaataattgatttatcatggaaaatagctaccagccttggagtcagaagacctgagtataatttcaggttatgctttctcaagctactgtggcaggaggaggtggggtggggtgggggaggactaataacacctgctctaatttcccatgtaagttgttgtgaaaagcaaatttgatgatttataccaaaatattttcctgaactgtgatgccttgtgaacacagaaggaatcattttatccatgaaagagcaaatatcttcccctgggatttgagatataagaaaccacctaagcataggaaaaatctggttcacagttcaattattatcaatgtaaggtcaggctttcagaagataactaaatatgtgttagaggaaaatgctagttaggaaatagttgtgcactaaccaagttggaaacgtttgactttcatctaccttgactggcgaaaatggctctgtggggtttgttttcatttgaaaaacatgagcgctgcacaccactgtgttgttcagggtaatatcaactcacagagagtatcacacacaccccaggaagccctggggcctttcaaagtgtgccgtctgctctagctttagagtgaagggagttgccaacacattttgaaagtgtattgtacgtagcatagcatatgactttccattcaaaggcaggactcttttctcattatctcactagtgcctgatgaagtgccttatacaggtgctcaacaaagggttgctgaatcaaaatgtttctcgaagttagaataaatggaattgaacaaattgcaggtagtgttaatgcttagtcaaatatctggaaaaaaatctgttaaatatggaaaatggcaaagcaggagtgcttggaacttaatccagctcaatcttctctaagttcatttatctaacaccctcaaccagccagcaaaaacagggaaacacaagcaaaagcaagcagaattctaataaaccgatgatgcccccctacacaagcatttgctaccatgcccatacacaaaggacttgagagagaccctcacgtcttcattcttattttaaacatggatctaatgaggtctaacaagccacctcctggtgtctccctcatgtattattatagaagggagaaggtgggagaatactctccctagcacgttagaagacaagtgtaaacatgccaatgataactagaaatgatcactgatagcaaaggaggtaaaaacaatactatgagaagcatccataaggaatttcaaacaatgttgatctggtgtcatttatgtattgggcaaactgctttccacatcccagtatcacttagaaaaagtcaaaatcatagcctagagcactttggatgttaactttttttttttttttttgatggagtctcactctgtcgctcaagctagagtgtgcagtggcatgatctcggctcactgcatcctctgcctcctgggttcaaacaatcctcccacctcagcctcccgagtagctaggattacaggcatgcaccaccatgcctcgctgattttttttttttttttttgtatttttagtagagacagggtttcaccatgttggccaggctggtctcaaactcctgacctcaagttatccacccaccttggcctcccaaagtgctgggattacaggcatgagccaccgtgcccagacttggatgttaatattgaggacccagagccaaaacaaaacaaaacaaaacaaaacagtgacatcatctgcagtactctttaaagaccaggaaatgtataattaatgtttgaaagtgcatatgttagattttgccacaatccccaatgattgtcaccacctccccacacacatacacacacacaaaccagagaagtgaagggaaccaacatccccacccagggctcccaggagagcggaacttatacccaccccaccctgggctcgaccctatggcttgctttagccaatggcaggtcagcagatgtgccagatgccctgtgtaagcagatgttttgaacagcactcgcagtttccatcagcaatcctgctcctgccatggcaatgccatgcctcagcccaagtcctggagtgagaagagccacagcttggagcagcatggagccactgccccctccatgaaacagcaggagataacccttttttttgttgtgagctttaaagatttccttgtgcaaattccgtgtgctttaaaatattttatttttatttgcttgttttaagttggaacttttaaatagttcaagtaaggcagcatggaaattcatgtatctagagaccctcttttcccctactgtgatagataattgaggtattactgtgaatagcctcagttaaaattgcacttgagatggtgagaaaacagccacaagcagccaaatgcagtgtgttaactagattgtgcctcctgcaccccacaagccaggatgcctggcctcatctccttgaagttagggagacaagtcctgctgggggtgggttgggagggggatctcagaggatggaattttcatggactggggatattgaagatgatgtcactcattaaggtgtgggttaaggacagctttctgtttctggaaaagcaagcaccccagtactactcggagcctgagaatgactgactgcgtgactatgcacaaattatttcaccttctgccttgtcaccaaggattaattaatcattgcaagttgtctcgcgactccacaatgctaaatacaaatagaggagaccctcgaattcatggagctgtgactcgtggtcttgaatattcatttttaaccatgccagtgcactctctcacccagcaacaactctttgttttactgagttctgagggttccccttctgtttggaaggtgaaaggggggctgtacatggtgtgtggctgcaatactgatggcctgttttgttctcctggggagatactgtaaggcacagtggcagattcacctgaagctcatttttgccccccaaaatttctccccattaatttttccagtttgaaattctctaggcatacaagatcttttagagtgtaaatgcacttcaagagaaaatacaaaaacagaacacttatgaaggaagactttggtgtggtgtcatccccattctgcccttactgtgtaatcttgaacagatccctaaacttccctgaatctcagttttctcatttaaaaagaaaaaaaaatgagtgaaaatagttcctacttcattggtgtgtggctatgataaagtgaactaatgactatgaaatgtttaatattggcacatgatcaatggatattagcaaaaattcttgcttcttgattaagagttgagtgtcatccacgtcttggaaattgtgggaatttggaaactcaggagaacaaaaagaaaaaggtggaatggtgagggacttttggcagtcacggggcagaatggggctgtaggatctgaggaatgaaggaggagctggcgataaaatgagggggcgaggggaaaagggagcaaaaagagagaaggaaagaagaccagacatgaaccctttcggttgtgcccagatcccggcactagtccacgtggtgctggaagttactccctgaagtcaggcaactggaaaactagggctccaaaactgttttcccttctcaactgggtatcagaccacgtgtcccaatttggggttgctgtgataagaattgaggtagataaagtcatttggaaagttgcaaacatgaccttggcccaatttcagcccactgcacctggtccccatgattcatgccccacttttccagctcactttgtgtggccgcatccctttccctactcttccacagtgtgggatgaaggattcagctcagcattcccagaggcacctaatgtcatggtgtctttactatcatggtggtttgatacattttttggatcatattgtttaatcgattcgaagtttgtttcctactgcaactatattcacctgccactgtctcaaagaggaggctataggtgatgaaaggcccacagggggcgattggcagatacggctgaacagaattggtaaactgagtcagggctttatgaaaacaaaagccaagtaactcactctgcctccttaatctctggtgataatttaccttaagatggaaatttcagcctgggagtgttgaacctatctttaagcttagcagttgtttaatgaacataacaaactccagcattgctctggcccctgtcagagtccgttacttcacatatgtcaagaatttgagcaaccttactccttcagacatggaaagagagtacgtagaaagagatgttagctggtcatttgaaagccactcaaaagaacacttctggatacttgttgaaggaggtgaaggctctcccatggaaaactccttcagttgttgatgcctaggatagactgtatgttggcatgtttgccttcttggcaactctgggaagggtgatcgtaaacagtcctgtcagctacaaaataattggcgattattttgtagatagaaaataatcctatcttgtaaatgcttagctgcttcagcccatgcgaaggtctgaggagtcagccttcacggaagagacttgcaacacctacttgtctgggcttcacttttcctttcgttagtgctagtgggttgatcgctgtactctagaccagtactgtcagcatcagcatcacctgggaacttgctagaaatgcaattttaaggccgggtgcggtggctcatgcctgtaatcccagcactttgagaggccaaggcgggtggatcacctgaggccaggagtttgagaccagcctggccaacatgctgaaacctcgtctctcctaaaaatacaaaacttaactggacatggtggtgcacacctgtaatcccagctactcagaaggctgaggcaggagaatcacttgaacccacaaggtggaggttgcagtgagctgagatcgccgccactgcactccagcctgggcaacaagagtgaaactatgtctcaaagaaaaagcaattttataggtctcatcccagaatcaaaaatgctggagtaattaacaagacctctagatgattctgatgaacccctactccacgttatgaattaagtacttgagcctagggcctttatttaagggttgtccttctcttgcgtagctcttttaaagtgtccagtattctgaagttaggagccaagtgtggtaaagatgtttcttttgggaagaaaagcttcctcaaaatctaattgctagaaggaagtcagtaagttgtcaaggaattttaaaaaaatcagtactaagattatgactctagcctggatcttcatctttcttgcctggctttattctccaataaaactaattagcaatttaactatgcaaattttggaagatttctgatttggatttagtccaaatatgaaagtagtggtacataaggacatttttcttagtgaatttggaaagcattgatttacagtagtccagtagtcaaaatccctttgagccagatgggcattaaatatgctggcttgctatttgtgtaactacagttttacaggatttattgatccaatacttaaccaaccaatggccacattaaaaacaatcccttccaactctctcccataattaccagtaaaccaccacataggtatgttctgtaagagatgatttaggagatagatagaaacaatcttgaattatttaaatcgtttgttatgtaaaaaaatgtagaattattttgtgtggctcagaagaatacagcatgactaagcatctagaagagaggggaaggcagatttttgttcaataaaagggagaatttcctaatcttaaatctcaccctaaactaaacaggtggcctagtgagtcccttgttacctacacagggacactattcactgatgagtgagaggttttattcattaaaggttgatggaggtgaacttttaagatccctttcagactcagagattccacaaggtgttttccagaacacctccttcacattagctctccaaagtcaggcttgctaacctcctttctcatatatgatctcttccctgaagccatattccaaggagaaaaagcagaaagcagatggcctgcatgccagagcatcatttttgatgatttcacaaaaacagtttatgatcatttacatttatcctttcgtgtgtacttcaaggatatgctgtatgcaagagatcttgatatggagggccagacgcatgtcaaatccaagcctttgtgttttcaaccctgattgaaactaaatacaattatgaaacagaaacaaagatcagagagaaccagcaaattaagaaaacatctagaagtccaccaggactggaggcctcagtaaactttaggagccctggtaaactttgcaggcagccagacttagtagacttctattaatgatggcaactattaatattttgaaattgacaaatgttgttctatgacacatttcatatttcaccatagcgagccaagggaatgttaggcttcagattcacaactttataaagcattttccaaataaaccaagctcctcactattgttggaaatagttgctgtgtttggctaatccacccatcattgaaaactgttttagtttcccctcaatttttatgcaaattttatatataccctaatcaagagaacatgagtgcagtctttatttttgtttttccttaattaataaacatcatctatcttcctttctatgcaggatgttttagtaagcttgcaaatattattaaagattgcttttctttttgaagactgagatattaaaatcagcccaaccctgttgcactgtaatctctaatatcacatcaggttttaataaacctcctttttgcagcacacatgtgcttgagacttcatggaaaccaagtcagaagagagaagggattactttagatgactttaaaatatgcattgtttgaaatggcctctggtgaccagctttcatgaatggctggctttacttgtggggcccatcatccagtttaattatatcagctcctttgtgtgacaagtgctgttcttgcatatgctgagaaatgaaagtttaaaacaaagtagagtaatgagtgagaaaataaattctggaagtggaacacccctgggtgtttgtacggaagaattctaaggactggtccacctataaacatctatttatagagatactccacagtgacagtaagtgtaaatttgccttaaatgtccctggacctagatcataatatgtgccttttcaggaagatttattttacatataagtaacactttaggatgctaatgtggctcttaaaattttcattctataaattcttatgcataaaacttcataaaggttacttttttgtaacattagaataaaatgctaagtttttattagctaaagtatttcccaacttctgtccagccagtaaactaacacagatgtcataaagtttcaagacactacaggttcattatttgaatctataaatgttaggaaagttatggttttagaaatctcctgttgtatctcttgagttgttagcctttctaaaaaaaaagaaaaagaaaaaaagaaagaaagaaattggtgagtcgccgtggctcacacctgtaatcctagcactttgggaggccgaggcaggaggatcatgaggtcagtagatcgagaccatcctggctaacatggtgaaaccccgtctttactgaaaatacagaaaattagccaggcgtggtggcaggcgcctgtggtcccagctactcgggaggctgaggtaggagaatggcgcgaacctgggaggcggagcttgcggtaagccgagactgcgccactgcactccagcctgggcgacagggcgagattccatctcaaaaaaaaaaaaaaaaaaaacaaaaaaaaaaaacttcatacataaactgatctgcattttaaagtttccttgaaaatgtctccaagcaaaggcattggctttaataggatatttgatttttttaaggttctcctgtaagtaatacattttgaaaaaaaaatacagctaatctccataatttgccttgagctaggaactagaattgtcttttgaaatgtgaatgcctccttcacactgtttcccagagctttctttcctggtcctctatctgcctctgcgggaggccaagggaaggaggaaggaacttgtttccccactctgctgtgtttagccctgcaaagaagttagagagcattatattggcagtgaacttgatggcataggaagtaggccagtgggctgggcgtggtggctcacgcctgtaatcccagcactttgggaggccgggacaggcagatcacttgaggtcaggagttcgagaccagcctgccaatatggtgaaagcccgtctctactaaaaatataaaaattagccgggtgtggtggtgcatacctgtaatcccagctacttgggaggttgagaaaagagaatcacttgaacctgggaggcataagttgcagtgagccaagatcttgccactgcactccagcctaggcaacaggcaagactccatctcaaaaaaaaaaaagtatgccaatggggttctcttgactgcagcttcatttatatagtaaagtcaggtgttcctcttcctacatacgactgtgagatagtatttcgagaaatgattttcagatggtatatttatgtttcgaaaccatttctcgtagtacaagatagtgtttccagaaatgccttcaaaacataaatataccatctaattgtctttttaaaaatatttacttcaacttaaaatgtatctcaagaattgtggaactttaaaaatttttgcattgcgccagattatgtacatcaggaaaacagactaaaacgaaacatgtataaaaaatccccgaatctgtcgaaagtatatttttagtgtctaagaatgattgaactttatactgtgagaaagattatgtttcttcgttacttgagatatgtgtctgtgtgtgggtatatatatttatacacatatcttaagtatgtgtgtgggcatatgcacgtgtatgtgtgtgtgtggtatgtgcatgtagagaaagagaaagaaatggggtactagtgaaatgtaatgtttgtggcatagacattagtgctcagcaaacactttggtccactaaattttccagtgtccttgccgttgagtggggccacaagactagtctcatccaatgaaatgttagaagtgaactgggtcacttccaggttgaagccctgaaaagctcctgcacaattcttgagtttattcttcccttgcttcctggtctagttattgcagcaacaggacaacactgcccccatcagtgtgcatccatgcatggctgggcagagcagagttctctgccattctatgtgtgacttgcagtatgagtgacaaatatgcttttatcatatttggaatttctttgttattgcaacaaactacttctgctgactaatgcaatatctcaaggtacttcagtacaaataagccatagatatataaaaccaaaggcaaatttaatgaaatttaatgtaataaaccttatattttaagacctagctaagatgcccaagaccacattttagttctttttaacaatatcgctgcccttcccccaaacccactttatgttttttcatcaacttttattttaagtccaggggtacatgtgcaggatgtgtaggtttgttacacaggtaaacgtgtgtcatggtggcttgctgcacatgtcatcccattatctaggtattaagcccagcatccattagctattcttcctgatgctgtccctcccccaaccctaaagaacccccaacaggccccagcgtgtgctgttcccccacatgggtccatgtgttctcatcattcacctcccacttataagtgagaacatgtgctgtttggttttctgttcctacgttagtttgctgaggataatggcttccaagttcatccatgtccctgcaaaggacatgatcttgttcctttttatcgctgcatagtatttcatgcaaatccactttacctgaagtttccaatgcctcttcttttggaaatccagttgtctcttcgttctcattctcttggatctcactgccaccattgaaaccattgatcatttggaccacaattggtcaccaatgaccattattagtccctttagacactttgtaacatatgcttcaggaatactgagttcttctggtggttttcataatatctagatcactttgttttcctttgtcttgttaatttcatctgaaagaagctggacaaattttaatttggactttatgcattctctaaaatgcccttcggaagcttgtttttatatggttttagtacctgcttttatgaggcagagtctcaaaggcacatttctcacttcatccttctcactcttcaaccctcacttcatccttcccactcttcaactccatctattttcttcctccctgagaagacagagagaaaacctagaaaacttaagtttatttatttctatgttttgtaatgcaacagattattgaaaaaattcaatatatatatgaattaagccaaaaaataaaatctgtccctctccctcaccatacaccagggataaccagcactcaccactgtgtgaatagatgagctttgaagattccttccaatttcaagattcacagtgttgtgtggcaggaggagaggagaaaggaagatctcatcatttagccaaatatttccccacaggtgttccaggtcataggcatacacttttcagctgtcattgtttgttggaagaggatttattattggaggagaataaaagtgttactacaccaggaggggatgattgtctatcttctttgcttggagttgtagtaaattagaccaggaaacaggctttctggagattaacagtaggtgaacttgccagctgtggggttgttaaaagaagaaattagctttttcgtggattcatgtatcttataaagaagatagcacatcctgaagccttactctaaagaaaagaagtaatctctgggagactcaaaagccaaaattaaggggaaagggccatgttaactgatcctaagaaatgtatgtagacagcaatgtaggatgggaggatgagatgtgggtaccagcttcttgctggtgtaattctacttcgcttgcctctgacaataatctaagcgtgttctggctaaattcagcttcgcataactgcataatctcccctgcccctgctgtttcaactgcttatggtgtcccttttttctctggcctaactataaagtgccattgctttgtactagaaataattcttctgccccatccaagagaggtttatttctgtggcgagtgggttgttctgaccctgtcccttgcatacttcagatgcatgggcattcatttgtaaaattttgtgttatccttgggtaataaaaaacacagaattttatcactcatcaacaacttttatctgagaccaggcatttagaactgaggacagtttcaaggctttaaggaaaaaaagtaaatgagaagcttgtgactagggccagacctacagccttaaatgtgagagtctgggcttaactatagaacaaggtacactctaagccagcaattctcaaaccctttggttgtctcagtatccctttatataattaaaatttattgaagacccttgccccaacagtttttatgtggattataattattaatacttacaagtgaaaactgagaaaattttcaaatatttgattcttttgaaaataataaatctattatatgttaacctaaatgatatattttattaaaaaaaactatactttccaaacaaaaaaattgtgaataaattatgaattcattttacatttttgcaaatctctttaatgtttatctgaaaagaaggaagtcgaattcttatttctgcttctacattcagtctgttgaaatacactgttctggctgaagtacagtaataaaatccagaatcacatgaataagtagttggaaagtagaagcattttaatagctttttcagatacttatagatattttctgatactacaacaaaacttggcaagtgataattcattaaaggttagttgtattaagaaatctgaagccatatcaatgaacttttcattctgttacaatagaatccattggtcatcttgtacttcaaatgcattttttattcatgtaagattttgtagcactgtgattatttgggaaatttggttcactgaactatgcgaatattctaaatgttgactcatttcattttacaatatcaaaaaataacatttgttaacatcactaccattgtcatcagaaaaagttttacttattgggagtctgccaagtgtagtatacaagttttccagaattctaattttaacttgaaaggtagatttctatcattggtaacaaacactgtcaattgtttcccttgaaatgataggctcatttcattcattatttgagaaaatgtctgccaaatatccaagtctaaaaaattcttttaagtaaaagtagtgtttcattttttgtttgtttgtttgtttaaagccactttagcttgcagctcagccaccttcatgcttttcctcaagacagccatcatactcccccagccaccaagggactttgtgtgaacctcttatctcagaaaacacaacagtgaaaagaaaagatgtgtactcaaggtcaaggtttaataaaattagtggttttactgcttcatcttaagtgaagctgggttttttttgttgttgtttttgtttgtttgtttgtttttactatatgtgaagcttctatcattcatgctaagacaaaagcggaaagcggttctacctactattgcttttatgccatctgtagaaatgtcagcgcagtgaagaaagcaaataatgtgtcagtattcttatcaaaatagttctgacctcatgaacctctcaaaagggtcacagggtcctccaaacgtcccaaactatactttggacattgctgctgtggacaaaagcaaggtgcttttgatatattggccaccatcccctctagagacctagcaccaagctgcccagccaaagtggggattggggaagacagaggtccccttaaacctttgggagcaacagggcttcagtttagattggggtattgtggaacaaacatatgtgacctaaacttcctatccagttggctggacatcctgccagtcttttttttttttcttttacatgtgacttgaaacatttaatgccacttttatagtttggcttgacggccctaagccaccctaaacaaagtcttgtaaactttccacaccaattgaccataactacaactgctgttttcattttatggcttggagtaaaagcaacttatatcctggtcttgactggtgaagaatagaacactgttcttcaaactcactctgtatgtataagaaaaacctttctgcatttctttcattttctactctttctcaagataaattgttagtctctaaggactcttgttgtcccccacaaagtatccaattcaaacattgcatccttgtctcttctgtcaagctccgcattttgtctgtcaggacttttttcccttctttacttcttttccttctagagctggaaaccaggcagttaagaggatgacaggctttaaaaggtcatttttgaataaagaattgtctgtgtgcagtgtttctagagtggcatgttttgtgtgttttagtgaaggaaggtgagatagagagaggactcgtgctggccagactagtcaaaaaattcaattttcttgaccacttaatgtatatcgttgtaggtatgaattccctgaattgaatgttggtggtggtgggaagaagctgaccaaaagttccaaagttctagtgagacaggaggaataaacattaaagatctgttgcccagcaaggtgaccacagttaataacaatgaattaattgtatgtttcaaaaatgctaacagaatagattcttaaatgttatcactacaaaaaaaatgataagcatgtgaggagatagacatgttaattagcttgatataatcattccacaatgtacacatatatcaaaacatcaaattgaaccctgtaaatatatacaattatcatttgtcaataaaaataaaaattttaattaaaaaaataagatacactgtggcagaaaaaaatgtagatcttttctgcacctttcattcaccagaaaggaagttcatttcataggaaaaaaccactctctcttttccatattaggaaatgatttttgatgtagtttatacaaaggtatcattaaagctaatttgctttttcctaaaggaagaagtaaagtaaataagataaagaaaagaataactagcaatgttgattgggttccagcaaaggttatcagcatctgaattgtcaagaactttcagcttcttgtattgctgattatttaaactcaaatgccactgtttgtctaacgcagtgagcctgtaactgttcctacctggttgctaccatcagcaggggttcatttacagtatagtggatgcacaaaggccctcttcacaaactctcccttcacacacctctgcaggccttgagaggtgagcaaagtttttgctacttaaggaaccaacctctaagaaatttctgtatttaactatttagcctgacccatgctttgtgagaacaagccattgtttatcattttattactttagttttcctgtcccttcatgcctgtatcaggtttctcacgatttaaaacaaatgcacagaaaccaaacagtcagtgcagaataattgcaggctttcagtgttcagcatgtacagcaatcactgtggaatcaccctgcgttattaagaagaaagcaccaaatcttacattagtgacttctacagggctgcgttatcaattggagctgtcttgtttgttgcagataatgtagtcaggactgcctggctgcagacactagagttttgtttaaaaaccgatttcttcttgtctctttctctctcttgcagtataattacaggctgcagagtgaaaagcattagaactgtttacaaaacagctcataaagtttaaaataatggggatacgtgtgtgtgtttgtgtaaaacaaaataatgtgtatggtaggggtaaacaatatccagtctttcttctttcactaccccctgtcaccttccagaattaagggcatgaagttgagagatggagccctttcctcctgctatgcgatgcttacacttaattagttatgcctacttatccaatgccagtttattgttgcagatcaaaatacagattctcaggtgtatggggactgagtggctgatgaaacagactgctatctaattaattttagggcagcctaaattcccataaagatgttccctcatgacatatgagaggaagattttatttttttaatgagccctttgctatctttccaagagaaaagctttcagcaggttagtgttccaaagtgagaggggcatttttccaaccctttcaaaagcctccttctgtgcagctttgcaaagattttgcagctcgcccttctggattttatttatttattttttaatgcggaagggtagccgctgactccagcctcggggccaatcaatcattttgctttgcaggtttaagatctgtgacaaagcgaaacccctgtgctatctgtgccttaccagtctcaccaacaataagcctggtgactgacaatcgagagggggctctgtccacgtaggtgccggcacaagctgaggacatgagtgggacagaggaaccagccttgcacggaggaagcaccttttccttctggtgattgattgatgggggacagtgaggaggttttcagagactggaaaaaattgtcccagtcacttactatgaagtctttgtcagcagaaaagactctccggggtagagaatgatataatgcagatgacaaatgacaggtgtgtgtttcgttctgcttgctaggtactcagtatcacacgcaggtgagtcagcgctccccaacatgccccttgcgccatctgctccccacatgcaaacactcgttcccaacgctctgtggtttccctggcactgctggctcttcctaatcgatcgtcagctctgttggggatgtgtaaagtactgtcagagtgtgagcagggtgataccttaccacccttttatggagctgattatgaaatgaagatagcatttgaatcatttgttagcagttctgaaagttgtttccttctgttcctcccttttggagcacagaagaaaaaatatatgtaatatatacacatataatatgctgttgcaagagactacttcagatcgaaaatctgtttttaaaatcattgactgatatttcctttgtatttttttctcccccttccaggaccctatctgcagatgttctgaatacctctgagaatagagattgattattcaaccaggatacctaattcaaggtattagctctcgtcagaaagcttttacatttgagctctgtgttggaaattctattttggcaatgaattgaaataggaaaagttggaatgagaataaaggacaaaagtgaatttgcaaaataatcaagtgcttaaaaaactacccagcacttgtgagggtttgctatttctgactcatgtgcaaccctgtctctgccagcttatgtgccaatactgacttatttgtagccctttctctgcaactgtgcttggagtttggatttcattttagtctcaccgtctccgtttttctctgactgcccagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctgggtgagacactggactcttcacttgttagtctcttttgttcagatgatttctcgagtctcaggattatcaggagacattctgaggctttgcacttaattattgcacattaaccaacaccctagtttacgcaatgaacttgtattgaccataaggcatttggtttgtgtttcagcattacttttctgatgttatgcttttgaaatggtcggggaaggggcctgggggagtaggacaatggagaaagagggtcagcactgaagactgtagaaggaaaggattgaaagccctcagttaagacattgtaaaaatatttgggcaaagttgtttcaaagagtatgaggatgtgactgtaattttatgcaatggatatgaatatagactgatactaaaggaactttcagtggttattagtattagagtggattacttattcacagtttgttatagtaattgttaggtaattcaaagttgcagtgttctatatgtcttttggtagagaatccacttactactaccttagatatgatgcttttttatttagcttgcctaggctaagcgtagagcacccagaaagcctgccaaaatctagtgattctaacttaccttctatatcacctgactgggtttcttaccttctcaccgtcttcaatggcccagccctacggtcttgttcataagccaagggccaattcttctagtccacctagtgcaaggcagatagaaagcttgcccctagaagttgtcactaccactcctcatttcttttcctgaacccaaattccttgctctcaggcatcacccagctgtgcttagccatcacattcaacctgactggtagttgaatcttctagcagagcatgctgggcttctttaccgagctcctgaggctcaggttcttgaggataaaactcttcacgctggcacttggtctccatggaaggggactttgctttcccacttgaaaccagacggtgagatcccagtaaagttaattccttgggttcagctggaagcaaatgcgctaaaaagccagcagatgtcattattgctgacgttggtttgaggagtcaacccaacttttttttttttttaacaagggtattgattttcaggcgacaggccaaaatgaaaggtgtcacacatacatgagtgtgtatttagcacatatgatgttagtatgtatgtaagtggtggtttaaatgttttcattcacttacagagcaagtaattttagcttttttagagccttgtgggtccatttcaagttagtttagtgcctaatgtgttaatagcacagtctctgcatgaggattgcaatgttaaacatatccttgccctctgcttgacctcacacctgaactcaccttccttaatatctcacccatccatcgcttttgctacagctgagatctctggatcctctcatctttcccagtttttccctcaccggtttgtcacctggcctgcctgcctcctctagtcttggcctctcttgcccacccttcactcaattgccagagttatctttcaagtatctctctgatcagatcacttttctgcttaagtcccttctgtggtttccctttgccatgagattatgcccttctcctctgtgggcaaatgagttctgagccttgcggcccctgcctgtccccaaggctgtttccctttcctccactttcactctgtgcttcataaacacaattgccatctccccaaaggtgtctggtggcttcacccccctcgcctctatccatgcctttgcacatctcatcccctctgccttttcctctttccccacctggagaaaccctacctgttcttcataacccagttcatgtcatgcgcttggtgttcccaaaacaaaaccaccctcccctccagcagcattgatggaactttcctttgcaccccgagaacacgactccagcatggtgctcattccaccatagccttccatgcctgtcccttccacttgaccaagatcaaccagagagcaagggtgtgttttatgttgcactcctcatgcactcctagtgcctgggaatatagtgggcactaaactaacttgaaatggacccataaggctctaaacaagctaaaattcccagaaataaatataagtattcatcatcatctacctcttcaatatacagcactgtctttaaaatatattaagaaattgctcataactttcttttttaacagaattcaaattttcagccttgtcctatagttcatttattcatccagtaaatattttctgagcagttaccaagtattgccttctgttggaggcatgtgactatcatggtgaagggttatagaccaggctcagccaacccagatatttcctacatatttgcctttaactccttccttgattttctagccagataacatgctaagaactagctcattggctgggtgtggtcattctcgcctataatcccagcacttcgggaggctgaggcaggcggatcacctgaggtcaggagttcaagaccagcctggccaacatagtgaaaccccgtctgtactaacagtacaaaaattagccaggcatggtggcaggcacctgtaatcccagctactctggaggctgaggcaggagaattgcttgacccgtgaggcagaggttgcagtgagccgagatcacaccattgcactccagcctgggctacagagcgagactccatttcaaaacaaaaaaagaactagcttgtttaactctcacagtaactctaggaagtagttactattctctctttaatttaggtatgagaaaaatgaggctcagagaagtcatgtagcttgtggtgagcaagtaaattgtgaaacccagacctgtattagatctgagtctccacagctacgtatttaaccactgtcccttccattaatcagccatctacaaataattattaagcacctcctaaaaacaatcggcaaattcataatattttaggttctgggagagagggaacagaagcaaaagataggccactggcaaaaacaaaatgactaggaaccacagtgaactgtgggttggaggtccagaaaagacctcctttcttggcagaaaagtcatgctctcggtagtggttcccgcttgatggagacttttcctcatttttctgtaatgtgctcataatccttctagaacattattgctctagattttgggtgttggttgttttgtttttgtttttttaccatcttaaccatttttaagtgtacaattcagtactgttaagtacatttacattggtgtgtaacccatctccagaactctttccatcttacaaaagtaaaaccctatacccattaaacagcaactcccgtttctctctccctcaatcctggcaactatcattctactttctgtctctgtggatttgactactctaggtatcttatatgggtgaaatcatacagcatttatctttttatgactggcttattttacttaccctcatgtcctcaaggctcatccatgttgtaacatgtgtcagagtgtccttcctttttaatgctgaataacttttcattgcatatatgtaccacatttttttaacccattcatccactgttggaaatttgagttgcttcctccttttccctattgtggataatgctgctgtgaacatgggtgtacaaagagctcttcgagaccttgcttttagttattttggagctatacccagaagtggaattgctggatcatatgatactcttatttttattattttgaggaaccaccttactgttctccatagcaactcaccttgttacgttccctccaactgagcacaagtgtcataatttttccacatccatgcccacacttgttattttctggttttgtttttaatagtagccatcctaatgggcatgaagtgttatctcattgtcactttgatatggttaggttttgttttgttttttactccagtgcaattttctttgccaagtgctttaataaatcttcacctaatgcaaacctttttgcacctgtaatgctgtaggcaattttggctactgtgcctccaaaaagaaagtaacagacttagtaaagacttagaagaacaattatgaaaattctaatagaatacttttctcactgggaaagcataaaacaatcctatctgtttatctagaaagatgaaggctgagaagggctataatcaaagtttataaaatcgagccagggaggaaagtactagttcattatgagcaggagcccttcccttcactttcaggacaaataaactattactctgtaaagggagtaagacacataaggaattcattaataaaagtactagaaccttgcatatggataacactttatcttttcccaaagaacattttgttcacattattgtgaatgaatattgccatctcacatgagttgggtgggtaggacaaagatcatcatcccaggaggaaacagcctgtggaaagatgaaatggcttaaccatggtccccttacttctgaatttgcttttcccacaacttaagaagttgttcacgttgtgcctatacccgtaagtacttcagagttttaggctagaataatgggtggaagatttacaattttttaagctaagtaaacacgcaaggaagtgatcaacataaagttcaggataatggctaccactggggaaaaagtgatgaccgagagcatcagtacattcacattctatttcaaaactgaaaaaatatatatctgaaagaatataatcatgttaagttttgttaaagctaggagatgcgttatttattctgttacaccctacacttgaaatattttataaatcagaaggaagaaaataaaaaatgtttgagggactcctaactttctgagcctagcatcaaagaaattgggctctaaatctttcccaaatggcctttggtgctagtctgagaaacaaaatactgagcagattagaccattgatctgactcaacatggcatttcttacattcctaggaaattgacctgacaggaacatctcagtaacattgacccgatgtttctcttagatcatatgtatagggaagctatgagtacatggagatattttgtttctttaaaacaaaagccagaacacaagatattcagaccagagctagcccacagatgtatgttgtttgatgagcatacttttcagaattaagccaatattttaaaatcatattttaaaatatatataacatataaaaaaatcagattctgacgtttcttgaaaattcaaaaaatgaaggcttgtattcccatgaagcagtcatcacttggatgtttgaaggggagctgcagctgctctcggacactgggatcccccactactgtgttgtccctcaataacttatgccaaggtgcaggtgccatttatcattgaccatactgctgtttttcttatagtcaggaaaagctctataaaccatgtctctatcaaaggtaaaacaacaaaaagacacaaaaaccctctgacttttcttatacctggctgccttcacttgcctaccttatctatgtagccctgtaggcatgttaacttccattcctgtaagtagcttttaatggccttgtgctcttttggaggggccaggaggaaatgatgagtcttagtgatctggaaacattccagactaatttattatcttctcttttttcccttcttctcccaactaccttttccccctttggttttaggtaaaaaacatcttttttttttcttgccaattccatagtttgggtagaaaaaaaaataccatttaattttgttattttttatatgcttatgcttttagaattagaatattcaatagatcatacaggcattttaataaaggaaatgtcactgtttcatgtttcatactttactatgaaaataactgttggcatgtgaaaatggcagggaagtacctaatacaaacgacttaaatatttaaagcattagccttacttcatcataaaagaatgacatcgacaaacacccctccacaatcagtaagagctgggtttgcttgttgttgtcaatcttcaaaccatgaatgctctaatccacatggaagtatctctctaggaagccaggtgtatatgaatcccacatgtctgggatttccataagtgataatgacaatatttactgttgaatttctggttctgcgagtttttctggacatgacaaacaggtttgatgaaatttttaatgtttagtaatacaaaatactgtatactcaaatgctaagatatatgtatcgggaaaggtaaagctttgttttgaagtttaaacatgtcaatgaagtaattcaggatctccgtgtgattttagcaaagtcatccaaattagggggacattttctccgatcctttttcatacaaatgatttttgtatgaaatcattctgtatgaaatgattttgggaatcaagtagttggagtatataaagtgatttaaattcctcactatggttctgtctagccacaacctatcacatactccatccaaagcactattcctggagctttgatttttaactgtgccaaaattgccaacatggtggatcttgatggattcctgaagggtggcacttctcccactcccagccaccgctgacctcttcagcatcctggtccacagccgatggctgtcacagcatccgcctgcaggagcaatggaagatgttctcagtcccagcctggaactggggcactgggacagtgtgtcttggcagtcctgtggcctggaccttccctctcatcaagccagcccagtcagcagtgcatgcacaccagctacacagacataatcacggttgcttcagagcatttgtgtctggctcccacttcatgggacaacttaaaataacaatgaagttgggctttttgcttagggtgaggagtcagtgtgtgtagaaaagggaagaattgatatttgtatttgaaaaccaatatcaacattttaagtcttacagcatagaaaaggtagttgacctctgttctctcctccagcttttggacttcagatgtagattacagagaagaagatggaagaggcaggagaaaatttaatgtgatggggttgaggtgagcacatagggcaaccacagccacctcggcacactccttacaggaagtacttgatggcatcctgccgtttgctcagcaacaaccttgtaaactagtcggagtggggagcgctattagaagctccattttacagatgagaaacacaaaccaaaaaaggataaatgacttgctcaggctaagctgtggcaaaatccaaatgttttcccacatgttcaagtctagggctctttcccttctcatctttatcatcctcacccctgccttgtgaatctgattatgagtgttcagctttacaattcatatcattcctatgaaataattgttgtaataactgagaatcagcaccgtttgcatttcaggcacccaaggcctgaaacctacagaagtgaagagcttcagcttaaaacaaaactgagcccttccacttatcggacagacattgtcctgtccactgctctcaacagctgtgaataaataactatgagttttattacagaatcatttttagtaaggtttgccaataaaaaaatcaatggcacaatcacagtgggaatatatacagggtaaggcagtgttattgactgacattaatcattgcacagccattaaaaggtgctcgatgctttccttactggtacacactaacacagtggagtgaagagattcagattcctgcacaccgtcatctgtctctacccagagaatccatagagatcagaggcaacaattaacgccaccatggcagtcagcagctaaagacagacagatccacagcccactcatgcctcatctgtgcctgagccactgagaccatttcagccttgaggggagggtaggagacaggtgttaatgtcagtcagtatctcctctaagaggcgagaagaatcaaaagatgagagtgcagaaagagagacctatcgcgactgcaagcagacgtcaattctgtttctcatcttgaaaatgtcaatgtcacagccagcattcagcctagatagagctcaagagcatggtctctgggaagactgcctgcatttacttctgggttctgctactgagggtctgtgtggccctaggcacagcatgatttagccttctgcacctccatttcattatctgtgatataggaataatagctactagcacccaccacaaaggattattgtctggatcaaattaattgctcatgtgaagcacttagaagagaacctggctgagagtaagtagaaaatcgatgtttctttttcctgtctacaatataccttatagtcttggcagtgatctaagccacctagatcactcaaaattaggcacccactacagtctcttccagctctaggcttccctgattctgtgtccaacctagaatactttttcaggtgagattcactgagaggcagcttcggcttcacccaggtttcattagaaacacaaattctcaggccccatcctggacttactaagccagtatcttggggtgggtacaggattctagggcttattatgcccttcaggtgattttttaaagttggacaagcattgtctcagaatctctttactgagaaccttcaagccagattcccactttttgttttgtttttatgagacagagtctcgctttgtcccccaggctgaagtgcagtggcgcgatcttggctcactgcaacctctgcctcctgggttcaagcaattctcctgcctcagcctcccaagtagctgggtctacaggcgcatgccatcatgctggctaagttttgtattttcagtagggacagggttttaccatgtcggccagactggtcttgaattccccgcctcaggtgatttgcccaccttggcctcccaaagtgccgggattacaggcatgagccactgagcccggcccgagattcgcattttcaaggaccccagtggtggagctgtattcttaacagtgcctatggggatccactgttgtcttggttccttttgacgtgtggactggtgggagccagggcatctggagggattgcttgggagccctacacaatcagctcagttagttaagaaaaggatgatactgagaatgagaggagaatcctagctggggcacttccagcagtgatgaattgggataagttttagcccctgtttttatattattttgactttaaatcagatttctacctcggtcccatatttgtagtctaaatgagtctgtaaactagagattacagtgctgcgattcagaaccttggatgatggcctcagctgcatttttcttttatttgaattctgctaaggctcataaaggaaactgggagcttgttctttgaaatagactactggacactgaaaagccatcaacagggtttgctgttttccccaaaatcaagatactcagtaactaactactgcagagatctaaagaggagcaatgagacatggtagaaatcttcagtgtcacctttcaccctctttccacttctacatctccgttcatccacttatctccaggatattccccctgtgtgatcaaccaacacaaatataaaatgcaacatttctaaaatggggttttaaaatctcccataaggcatattcctttttagttacttcttcaccatcagtgaaacgattggtttccagttttcttctcacggtgaaaacttcaaggtgttagccaactcccagccttctcatgcatcaccacatcacttgggtctgcttcttagggtcgctctgtgtcagaggcatagtcgtccgagttcttctttcctcaggggtagacggcttcagcgacctcatctgcacccttcgtggaccagcagcagtgtgccctcctcaatccacacaccaccattgcaactgcaacgcctctcgaggggattgcaatccactgcagcagcaacaccttacaaagacttttttcttaacatgccgttcgtgtctttgacacagaacataactctacctttgttttttttattctatcacatccagtatctctgcccagccttcaagctatttgctaaatctgctttccacatttcatgaagagaattctccatatttctcttcatgccaggaaatcaatgtgttgttctcatcactctacttgtttcttcccacctccagagcatcacacatgtcactcgctgcaatcccccaatgatatacttcacccatccgacatttacttcctcctttttttccatctgtcctcatctctcatttcagaactcttattaagccatcaatccaagttccctctatttttatatgccctgctactgctgtattcacattgttacgtgtgcattgctttgcaaatatccccaagtgatttttctatgtaggttctcctctagagaatttattactgaagaccagaggcagaaaatttcccatttcttttgtttatgctacacttgggagatcagcccggaatgctgaggttgatagaatgttttgcatgaagtaggcactcaagacatgttattcattgactacaaaaggttgcttgatgccctgaagacaaccagaagagaaagagcagttaggattgctcctagccgaggcatattttagggagctctaatgagacccaattagaaaccctcctcctgttctcatatgcgtcatgtgaacggtaaaagctagtatatgaagacacggggctaactgtggctttttggactgttgcatgcttctcttctgccctgaatgcttgcctggtttgcattacgatttccttccttgctggaaaacatagactttcttcctttctttggaagaagtgggacctgttggaaatctgaggctccaagattcaaatgcaatgggcttggctgtagtgctctgtagtacacttcttgacaagtcctgaaaagactattgaattctggcctgtgcttttctgcagtgtttggatgtgtttcagctgcagtgtttggctggacagagtaatcgaaatagtttttttttttttttccttcctcagcaatcttacgttaccagttgatccttaaagttaaaatggaatattttacaaccctgcaaatactttcgagtgcaatcgaattatagctctttcacaagcaaacagcctatctttaaaaaattgtgcataaataggtcaaaatataaattgatgttgttatcctaatagaaaaactggcaaacatttggtgagcttgctagaggataccaacttgcattgaagatcttttttaattattattaaacaaacacaggcattttgatgggacttaatatggaagaaatttttttctcttttctttcatacgattaaaatgctatagtagtaatctacactagtaatctagtagcaatgtcactagtagattgcatttgtgctgggctgggggttttgatgctctgtgtatcaggctattgttctctggtaatcttcaaagggctgctggcctttgaatctgctccatatctaaaattctagctttaattatcagattagcctgcatttttttttcttcgtgattacagggaggagaagtgtatgtttattattctgcaaaatacttgagatggtaggatctcaaatgcttaattttgttgtagaaatgagagctgatcaaattatagactcctttaagctaaggaaaggaaatgaataagtcagggaaacagaggcactgaggggcacaatcgaaataggcattcatgtgctgcactttgctaaacaatgctggcactgtgcctttcagggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggtaagggatgacgtttctagcccatgaacgtcttgtaatatgtcttagactcaggaagaagtgtcatgtaatgaaatgcatgaagttccaacaaatacctaaaaaaggatcaagtgtttttaaactgcttgacatctaccccagggtctgggacacagtaaatgatcaaaattatttattatttattaattaatgaaaaactgatgggtaaatcaatcatgtgtaccttgttgattcatgtatttgttcattcataattaataggatttggaaagtttctttagcttgtggttgtttttaggtctcaaatgttcacttctaccttccaggaaaggaagtcatcctaattgctacacctcctattattgtttaacctacacagggcaagaagaggtttttgattaattggttttttgaaaattggggacttctttcaagaggggtagtgaacatcatgccagtctttctgagaaaaaagcaaggttccttctggtaatattagccccaaggccctatcctcccagcatgtagatgatgtccttgggttttttgtagcatttcttcataaaagggcacaacgttgttcgtagaagggctacagtgcagacatgggttgttgcttgtttttatttttccagaatcacctaggcttattcataagaatcaaatatgttatgattaaagcttgttcaaatgactttcaggcctacaatttctctattttgaagatttaaaagtaaaggagttcagataaatattctcctgcatctcttttaaaagtgaaattaatctttcccactggactcaggaaatatatggccatttgcttctttgcagagcgccctacgggcacttaatacttgttatttatggatgaaaatattgattgtgcatatgatagcactgtcactcgcagacagctcaaagtctcgactcgaagcagctcctcccgtgcatctcaagggtgttttcttatgcgtaggaaagaaactaggttacgtagaggttacagagagtgccttatctgagtgtgttttctcacattagtgatttaaatttatagcacctttcatttgaggactctaaagcaatttgcaaatccaccaaacatccctgtagagttcatagatggcaaatgtacttggctctgttttataactgaggtggggatttcaaatattgcgtgaccagctcagaaacagaatcagaggcggttccctaataaccggttcctgattttaaccatcaaattgtgttttgcttctgggaagtgttgtgtgaaatcagtgcctttcacctcccaggttccctagtagcaaacatggaactggaacgattgggactctcacatatccagagtgaaatggatgacatttgtcataagaaatagagattgagggtgagacagggccctgccaggacttagagcagtcaactagggtttgctaatttgtttcagggctaaattaggaagggcaagaaagaagggaactccattttgccattatctcacctaattcctagggcaatcttgaaagaaaggaatttcccatgttactaatgaaaaaaccgagactcagaaaggctaattgtctatggtcatgagctagtcggtgatggaatgaacccagcacatctgactccaaagtctttcctctgttcattgtcttatttatttatgtaatgattctcttctgcctcattccaaaacgccttccagagatacagactttagaagctacagacccatgaggaccctggcaaacagaaacaaagagtaggactagctaaagtcaaggcaaagattgctgtacaaactgcttgctgtggagttgtagggaaaggtggaatatttagaactaagcatccagatgttaagagcaaaaatggaaacaccatccattgtaaagttcacccagtcaccgggataaaaacaattcagttgcctctaagcatgtttcctggtacttgcttcggttatactgtgctatatccaccttaagagggattgagagagtttaactaaaactcaaagatgatttagttccatttccttatttttagaggagcaaatttacacccacaagaataaagtgactgaagtgacagatctgactgttttttatttatttgtttatttattttattttattattattatactttaagttttagggtacatgtgcacaatgtgcaggttagttacatatgtatacatgtgccgtgctggtgtgctgcacccattaactcgtcatttagcataaggtatatctcctaatgctatccctcccccctccccccaccccacaactgactgacgttccaatgggaagagccggcaccgggaccttagtcttcagggctctctccagtgtgctgatcaaaccttaagaatcgggtctgggatgaaactgtgtacacaccggaaggcttccctgttacctcaatggactgtcacttttttgtgcagcccgagaagtttgtttcagtcgatgtcttctccagggagagtagatttgctcctggaaactaaatctgtttctaaaccttttccccagggtttagacacttaggtaataatacaatttatagtgagtcaacctccaaaataaaaggaattctttaagggaaataaagacttttccaaaaacttagttaacagtaggaaaaggggctgggtgcggtggctcacgcctgtaatcccagcactttaggaggacaaggctggcggatcacgaggtcaggagatcgagaccatcctggctatcacggtgaaactgtctctactaaaaatagaaaaaattagccaggcgtggtggcggacgcctgtagtcccagctacttgggaggctgaggcaggagaatggcgtgtacctgggaggcggagcttccagtgagccaagatcgtgccactgcactccagtctgggagacaaagcgagactctgtctcaaaaaaaaaaaaaaaaaaaaggaaagaaaaaccagtaggaaaaggataatatgggctcaggaaaacaaatctagatttgcctattagtaaatcagaaaaaataaaaattggggccgggtgcagtggctcatacctgtaatcccagcactttgggaggctgagatgggcgtatcacctgaggtcaggagttcgagcctggccaaaatagcaaaaccccatctctactgaaaatacagaaattagccaggtgtgttggtgcatgcttgtaatcccagctactcaggaggctgaggcaggagaatcacttgaaccaaggaggcagaggttgcagtgagccaagatcgcaccattgcactccagcctgggcaacaaagcaagactctgtcacacacacacacacacacaaaaaaaaaaaaaaatgggaagactgaaatggcagtgatagagatctctataatttaatttatccttgatgggaaaacattacagtatctcagacaattaggaagtaaaaatgtcttcatgacaatagttattgatccaaccatggacaacaacccatttgaaaatacacaaataagtacacacaagtggcaggaatcttagaaaattaagagaattggtaggtagatattaaaccaatgtaattatgagacactaaactagtagggagaaagtcaatgtgtaaagattctattgctttcctaataatgaatttattatttggaacatttagctacaaacctaagaaaaataatgacggaaactgaaatatgtactatacatacataaatatccatctagagagtaagttttatgtagaataactcagagaaaacaaattactaaagggcttattttgggaggcgtccagaatccatggatttaaatgagttgaattaatccaatattatatttaccattgtatgacatgagttttctctttcagaactgaggcatatttttggactggctatagcctaaatttttctaagtttactcatggaaaatatgagtctatgagagcttgaatgttcaagaaggggaaaatgcagtaacatgtcgactgcacttcatattctgacaagtgaaataggaatgagattggattatatatcataaaaatgattatcctgcctgaaatcagctccaaaaaaattaacttaaatttattatgaggatatcaacattaatataaaacctggcttaggttttaaggtaaaaataattatccatggttgagtgatagcattaagtatttaacaacaacaaaaaaaactgaagcaagattgaaaacatcgtggaatcacattctaccttgatttgttttgaggacttggactggccagttttccaatctgtatgatgcagagattggcctagaatgattcctaagttttctttcttgtccaaagttacagtgtgttataactttattatactcatggtaattataatattgattcatttaacaattgtggtatttgaattataatcctaacacatggtacataaaatcacatatgagttaaatcttaatcacatgaattctacctcacatcactgaggtagaagggacaatatttaatagacagctgcaataaatatttttgtgaagaattcttttgtcataaatcaaaatcatagaccttagttctgaaaaagaaaaattatatcaaataatggtaaatacaatattggatcaaaaatttttttgtctttttacgttacaaaatttatgttacttatagcaagtatatttattctctaatatgagattttttaaatgtagagttcacttaaagtaagacaaactaatattcttaattttattatgatgtagattcttgatacatgcataaacatgagaaatgtcatacatttattaaaccacagtgtgcttggaacacactagacattgggatgaagacatttaaaggaagattcctgtcttcactagacttacaatctagttgaggaaaccagactgctgtatacaaactgacattaatcataattttaacttggttcaaaattatttatatttatagttactagcgtgaaatccatcaccctaagtctatcaattacgtggattaaaatctcaatatatcttttgatacattaaataagatttgacttttctgcggcatcagatctttgggttagtcactattgctggctttaaaagaaattccttggcttcaggtagttcctggaaatttttctaagcattatggaacaggttgtcctagacagaagtagcatggcctgaagccaacaataattacaatcaggtcttctgatctttctccctgccccccaacccccaccaccttcttaaacagctgtgaagggaagtgcttaatggtatccaaaacaaagaggatgggtaaatggcacattagtgatgtattcagatagtaggagttgaattgaattgccaatgccgaaggatagaaaaatattgaactatacgtaacctacatgtagacataatggcagtaagggcaagaaagctaaattcaccttaggaagggaaaaagagatttaatacatctggaggaaaataattagagggccagataatcaattgcagagcgccgccaggaaacatcgtgttgaaagaggccggggtgattacaaacgagtctcaatgtcatgaggcaacaaaaaggccagagcaactggaggccaacagtgctgcaccctgacacccaaggcccccatcagccttggaatgagtgtgatgggtgagcgcacatctggaatactgagtacatttcttacgctccgttaacacagagacaccaaaaacctggagggagttctgaagcaaataacaaggactattaaaagacttgaaggaatagtttataagggaaggattaagtcaaaggggaatgccatggcaatgggtagaaaacagtacaaaatatcctacaaagtaaaacaatgaggaaagggcaggaatgacttggggagaggaaacaaaaaaaccccaacaatgaagtaacttaaagtgcagaaaaaaaaattaaaactaattaagcagaaaaatgtaagccaaatggaggagtttgttgccacaaaataagtagtagtggggaagaaaatatgtaacctccgaagagatattttcaagtgcacaagtgcagaactctagtgcgagatttccttacactgcaggatggaaaatcatttacaaaagacagggccaaaagaatactgctaatggtgatgctaataacaatattagttgtaggagcacttaacaagccgttgttttgtgccaggcactgttttcagcgctttacatatgtgttgatgcatttaatcctcaaaacaatcctgccaccattattattatcaccatagtggctttgcagaaggggagttgggggagggagaagtgaagtaacttgcatgtagatggataccctagcaagtagcagagccagaatttgaacccaagcaggctggctctagggtttatattctcaatcactatgctttttgccttcttggaaaaaaaaaaaaaaaaaggaaagaaaagtgggataaacccgtagggatgaggaggaggccaaggaaagcacggggcttgaggctgttaagtgcaagctttttggaaacaatcgcttttgaacgttagtggggtgtggccttggtctgctgcctgtggctccaagtcatactgcattttgttggaaaaggaaaatcatcttgtggttctatgtgaaaaggtcagttcgtctctaagacaggaattcctcattaaaagaattccaactacacgtagtcagcacagaaggaaatcctgagtcacctgatgtgagaccctttgacactttgccctacactgatcaacgtgctcagtgcccctggcagaatgcttaagcagcgggcacttggctgactgtagacctaattggttcactcattcacagagccaacaaataaacattcattcaacaaacaaacattgccatgtttctcagactggagtctagattcttttaaaaataatataataagaaataacaattttagaaactctaaagctctattctatgaaaatgttttgaaggccaaatcagctttaaaaaatatgatgatttgattgggcgcagcgcctcatgcctgtaatcccagcactttgggaggcctaggcagatggatcgatcacctgaggtcaggagttcgagaccaacctgaccaatatggtgaaaccccatctctatttaaaaaaaaaaaaaaaaaattagccaggtgtggtggcgtgtgcctgtagtcccagctacttgggagtctgagacaggagaatcgcttgaacccaagaggcagaggttgcagtgagccgagatcacaccactgtactctagcctgggcaacagggtaagactccatctcaaaaaaataaaaaagataattcaagcaaaatcacaaaatttttaaagtctagacctcgtaaagtccccagaatacattggattcatgaacccaaattcaagaaacaaaaaggatggagccctgaactgtgtgcaaggatggagagtgcctcagagataaggcagaggcaatgtttgccctcaaaaagcttacagtctagcaggtgttcagcttctatatgaacatgactataccacaatggagaaagggaagatgacattacaaccacaaagacagtgttgtggaattaagacagagactgtgagtgaaatggcatctgctctggccttgatatataaagaggcaaataaagagaattgcacaagcaaaaatagagaggtgggaaccagagagcaaatagaggaaacattagctggagagagggacgattaacagagaaataggagatggggttggaaagggaaggattttgtccaaactcaaagtaggcctctgagggcaagctagcagagtacacttgattctgcaggcaatgagggtaatctgagattgcgagaagagggtgaagtaaccagagcaggtccttgggaagattaaccagtggcaatcgaagtggaaagaccctccatcctggctgggaaagtcagtgagaccatgagcatctgtgaggggtggcaagttaccagggatggcaggagggatttgagcactatttccaaggcagacctgataggaggtggcaactgcccagcaaggggagcgcaggagcaggcgaaagcagagggggctctggagggccaagcatggttcatggagggtgattatgccattcagaggaatggagtaaggctgaaagggaaaactggtaattccattttaggcaatggcattaggaagcaagtaaaacattcagatggaggaattctacaggtacaggtgctccttgacttacgatggggtgacatcccaataaacccatcataagttgaaaataaggtaagtcaaaaatgcatttaatatactgaacctaccgaacaccagagcttagcttagcccagtctaacttaaatgtgctcagaacacttatattagcctacagttgggcaaaatcatcgaacacaaagccaataggcttgtaataaagtactgaataactcataggattgattgagtactgcactgaatgcataccaattttacaccactgtaaatgtgaaaatcttcaattgaaccatcgtaggtcagggaccatctgtagtcgtatatcaaagataaaagcaagctaaatacctatcccatagagacatcaaaattatgtacatcattaagtttaaaattcagaatgtgtgttttaagaccaatgtcaataaagtgctgcaattctagaattcgtttctattatcccaagccagtcttccaggaactacttttttaccatggatataagcgagggcacctataaaatctgtttaatgaagccaggcattggctttgacatggaaggcgtctggcaacagctttataacatcagaaaaactaaaacttgcctacatatgtatatgcatgcataggggtgtgtgtgtgtgtgtgtacacacacatatatacatacacgcacacatgcttatacctatacagacatatataaaataaagttttctctagccctttctacttgaagggaaagctatgtgtgtggctggagtgactaaacatttaggtttacccagaatcatgcttgtttatacctgcttttctgtaattacagcaattacaaataacatcctcttgctctctcaaaagtattccagtatatttatgactaccattctgctaggttgtaatgtctttttcacttcaagaatgaacccatattgttcctggaatcccagcttcttctttgcttcccgtacccctctcctgtcatcatcttttgcagaagaccaaatttctagtcaccctctcagagagaccgagtcagccctgtggcacagtggtctttcttggaagtgacatgccaaagttataaatgtgaaggccttccagtggcttttttagtgaactgtggtgtctttgtgacacatacacttctactatactataattgtatgaaaattagtaatctatgtagtaactctatgttgacagaatttttattatcgataatagatgtatacattcataaaatacacataacataaacacccattacatactatacatgtgatataaaccctgaccatatcccataaaaatggagtttaccatggttccctggtttggaaaatttgtactctctggatatgtaaaaacgaaaataagcttttcaatagtgtttttataattcacaattctcaaatagtaagttagaaaacttatcacaaagactgaactttcagttctccaacacctgcccggtggttgcattccaaatctcacgctacttctctgattgttccatcaacttaacaaaagagcatagcctgattttactccagtaggaccataagaaatgaatgcacccagagtgctgtgatcattatgatggtttcattgagctgtaatccatgtacttggatactacttctatttattttttaaaaatgtgtttgtgtcactttgccaaaggattggagtattacactaatgtcattttggcattcactattacctagggcaacttttgttttaccgtctctttttcaagtcataattttatacttatccatttatttatgattaatcattttacgtgaaaaaaataattcttttttcccactgcagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggtaattttcaggcacttttacactgcatcaatttactttgtgcataatggggaaaagccattttcagtgagttaaactatccacaagattggctttctatgttctcacaatgttagcatgagaaatgttaaggtaattttaaactctaggcaaggaaaagactctcaaggaacgctgcctttgtgtagtgatttccctcattaggatgaaaggcaatcaggctttgatgaaagtatcatcaagaaaatcagaattctctgctctcttatgataatttttgtcctcccagttcccccggacccaaccaaggacttgtccacataatcaaatgttcatcttgtactgttttacttttcactgggacaaaagtatattttgtctgtggcttcagatttaggcacaagcataagagcaaataaatatgataattaaagtttgaaaaaccacattccttgcttttactcctgtctgaccaagcttagtatacgtgacaaggacaccttccctatcacggcaagcatccacaaaagtctctaatgctatcaattctaggattttcaaatcagttcagagaaactgaaatcaacatgtcccatagttctttgaccagtgggttctagttttgacttaaaaattcacaaagattttgtgatagctgacttaagtttaaatttttttcaaatcataagaatgaaggggaaaatatcttcgaatttagcatgcttatttgccaaaatatccccttcccttccagccatacccatctcttcttcatttatctagaagaagccgagaatctgctctatctagcaacctctcccaacaggctagatcacttggtagaaatcggaaggagagaacttgatttaatgttggcatattgctgtctttatgcttggcctgatttgagcacaagggacttgatgggagataagattaagtccagctcctttatacccttcagaaaacaatgaatgcaaatgaattcataaacattgctaataggcttccaaactcatgaaagttaaaagttagcagagaccttggaggcaaatttgagcaatgtcctcatttgcaaagatgagaaaaaagcattctagagtggctcaaccactcatcctaggtcatatccccagctgtggatacaatcattgcaagcaaatggtgcagaccacgtgcactaattgtcactgctctcctttgctgtctgtagggatgctttttcatgctccttgttcaagttattaacctttctttccctgctgtcctaaagagagcaaagtaatcaagattctctccaaatactaaatcagcgtaacttgttcattatcacagctgattaagtgtcaaagacaactgtgtctgaaaagaatatatatctttttttagtgaggaaaagaatgaaacagacactcccttggaagaggaaggggatagcctgtagacttgccctaacaatgacatgcggcacacaccatccctctgatactgcttttgcagctgttctggtccttaaatccacaacatgtgattagccatgcctggaagccttcaacatttgcaaatattgcctaaacactttctgaataaagtttatactggagctccaagccaatgacacacacttaaaagaagcaggtggtttaagttttcatcttttctttccttttcattccatttcctccctccctcttacagacctgcatcagccccccctgactgtgggttaagtcattttattagcaagtcaggctctaatcccagcagctgtattgctttagttgtgcaattaacacagtataatctgcaggaaatcaactgctccctattcaagtgtttcaagtaaattaactgatcaaatgttgcagcttttccctgtgctcctggattttggccatggctttgattactgattattgtaattcccacaggtggatttttcgtttgaagaaaatatcttttcttgtgtttatgtattcatgggcgtgtgtgtgtgagcgtgtgtgtatgtatgtgtgtgtgttctgcaactgtaaatttgaagtgggcgtgggtgtttcctgcccttaaagtaattaaattttttgccaaggaattacatcaatgaaacctgagactgaaatatgtatccggtgtttcatgtgttctagtacttttatcgccagattaatcattatcttgggcaaacacgacttgactttttttttccccattgctaagttgtgtattacttaaaatccatttttcgtatgttaccaagctagcaaccctagaaaacaactggcagctgattttctctattatcgaaaatgttcggctgccttgggaggtgcagccttccttcctgctgtagaccttgccacttcgtgcagtgaattgcttctgaggaaagcagttattcaaatgcgatctgatgaatgtcaccttttgtaatttttgttttgtgtcaaatgtatgtttcaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacatgtaagtaacaaactcaactctgcgacctgccgaacatgcctttcccttttctcctcatcccactcctctcctttaccccgtttccttccaccctgcgtatccacaaggctttcttcatgaaaggataacttaagagcagaccacggaacaggcagagccgctgagcctgaaagaaagcgccttatctgggtggtttgaggaggaatcaaatttccagcatttacaagtagctaaatagaaaggaagagatgcacatagagtgaatgggggcaagttttacaagagtttcctttcgttgtcttaaataatattcgtgtgtctgatctaataatgatgatgatcaaatagtatgcttttcatagctgcacagtggggacctctggtctggttatagaaacatggatttattttccaggcgaataccgtagcagctttgctgcagacgtgcaattagaattcctgcagaaggcagcttgagtggcttgcccaagagggcttctcaggtcacagctttaaaataacctgatttttttttttttaaagaggcaggagtcttggagatggggggtgggaaggcacaagggagagggctgatggcgtggagggatgagacagaacaaagagctgtcgtgtgcccacaattctcaccagccaaaggtggaaaaatctagatgctttggcagcaaagaacatgattttgttgttcactcagttgacaccatttcttcctaagctttgccatcaatatccagtcttccacacagagcagtggagttggctctgtgtctgctgaaagcctgaccattagggagacagggaacagaaaattggtatctgtttcctatattgtgaaacctccaaaattggttcttaatctatttgtacttaaatatcatctcttttcatccacactggttattagccaagattccaggcagaaagaaccttacgaaaataggtaagtaactatgcaggctctctagttgccggtcactatacatccctagagaagtttttataaaatgttctcttttttttgagacagagtcttgctctgtaacccaggctggagtgcagtggtgcaatcttggctcactgcaacctccgcctcctgggttcaaacaattctcccacctcaggcttctgaggagctgggactacaggcacacgccaccacacctggctaattttttgtatttttagtagagacgcagttccaccatgttggccaggctggtctcaaactcccctgacctcaagtgatccacccacctcggcctcccaaagtgctgggattacaggcatgagccaccgcacccagccttataaaatatttttatttgtaccttaatgtaactgattgacttatgactcctggtcagtggtacacagatcatctctatgatatcatgtgacttagaccagaaagaaggaggccagagctgactcaggacaagaactaacaatatgaagccagggtgggttacctactgagcatgcccaggaactcagaggatggaagtgttttaatgcataaaatatcatcgacaaatcatgaaggttgccccagcacctgggaatatagctgggataagccattatgttttggagtcaactccatgggtggatatttaagcttctgaagatcttcccctatatacaactctgcgagtaaattcatgaatgaagcccatgtgtgacaagtggctctccattatagctcacttacaaatttagtagccaactgattcaatgaaaggaaaaagtcctgcgggctttttcaatacccctgaacccccctgttcccatttctgttgaatcagaaatcactttacctatctttgttgcattagcagaaacccagtctaaggtgacttcctataactgtaaactttacagatgttccctcaagctggaggagaaggggttgacaaaacagagtgttttgtggctccttaaaagtcagcctgcctttgaagctttgaggcaaggtcctaagcctgcaggaaaatcagcctcaggtcaagagtttataagagctcagttgcatggaatcagtactgcatgaggggaggagcctgcagagttctcagggtctcagcaatagctttttgaaaaacatctctgtgctggccaggcgcggtggctcacgcctgtaatctcagcactttgggaggccgaggcgggcggatcacgaggtcaagagatcaagaccatcttggctaacactgtgaaacactgtctctactaaaaatacaaaaaaaaaataaaaattagccaggcgtggtggtgggcacctgtagtcctagctactcgggaggctgaggcaggagaatggcatgaacccgggaggcggagcttgcagtgagccgagatcgcaccactgcactccagcctcggcgacagagcaagactctgtcttaaaaaaaaaaacaaagaaaagaaaagaaaaacatctctgattccagtaattaaaaattctatttcattccacgaatatttatcagtgccacatgtgacactatgcagcccagcagggatatagataagcgtgaggaagacacagttgctaacatttaaggacagataaactaaggcaggggttggcacactggtacccacagtccaaacctagcttgccaccagtttttgttaacaaaattttattgacacacagccatgctcattcatttatgtattgtctgtggctgctttcacaatacaacagccaagtcgagtagttgtgtcagataccatacagcctggaaatactatctcatcctcgataaagtaactttgccccaacctctgctctaggggcaggatgggcaagtgtcccaatggcaatatcaccaatagggccagaagtgacaagcacagagcagacgttcgcagggctgtggagcggggagggagaagccttcatatctttgaaggaaaccaggaaaacttcatggaccaaggcttcaaagtgggcctcaaaagatgggtaaaatttctgcagataattgtttagagattgggtttcaggaagagaatatggcaaggacacgtggtcactgtataagggaggcaatctaagatgtgtcctagaaactggagaatgggctacaaagaaagcagcactaaggaacaatgctgcagagggaaactgttgcagaatattgagggtgtcagtgagtttgtatgtaactgcaagcagagagtcactggaggttgggtagtaacaaaataggaggtggctcagacatttccacatgcaaatagattcagtagttcctttttagttcaaatgaaccttctattgcccttattagtgattctataaagtaaaatctacacagtgcagagggtggccttagaggctaacgagcctggtttcctgcctcagctgccctcactgagtgtaggggtgctttctttaatctctggaaacctccactgtctcatctgtaaaatggagataatactaacaccttgatgtgatgtcatgaagagaaattaagagaggcagtgtaagtaaagtccccacatagagcctgggacatacaagccacttcataagtgtcaattcttattgaacctttttattaagaaactaacaatattctatcattctggacctacaaaagggcaatttcatgtggctcaacttaaggtttaggggaagcagtgagagaaatgacaacttgatgcttgtccattgtgacatgacagacctcttgacaagctaagactcccattgtgatgagcctctcacacctggccattccaatggaacagacagggtaaggaccaatctggactgtgttatcttttccaggtgcaagtatgtgctatgggtaagtgccagtttggagaactcccttagccacaggaaatgaaaattcatgtgattgtttgaaggattcagcttctctttgctgctaatccttgggttttgtgcacctagaatgtggtctcctgcaggccctgaaagccttgaattcctggcatctttgctgtgaaggtctccctggctgctgctggaggaaggggctggaaggagtgagtgtgtgcacaggttcagagttcagtcttcagacaaaaggagtgagataaattgaagacaagctgccgatggtagtgcatggaactgctcaatgaccagcttccttagcgaaaacattagcaacacattcaggcaaagggatgcgagaagttaagtactttgcagaaatatttgacaggccctgcaaacactgagcaagaaaccataggttctccccaattgcagggatgcaagtaacgtgaacactttcctttcggtcatcttccttggtggtcaggcatcatctggatcactttcatctggcatcgggttataactacctgaccctctcagactggggtgaatgtatcatctttccaaggtgtttgccgttcccaacaaagagaggaagccagttcgctattggcctgttagctttacaaacggatggtagagcttatgcttaccaaggaagagtgaaaggggattatcgaccacttgttgacagggaaaatagtttaatcaaactgtaactcagctactcatggccactgagaaatctgagaaagcctctgtcataataacacacataataatcctagtattagaaagccctgcgctctggctaagactctactatacttttcagtaacttatttccccagaatctccatagggatgcaattccttcacccctgctttaagttacttctctctcctcgcctcagtgatgtcatcatatacacctgtggacaaaagccgtgacagggaaggagatgccatttacgtccctggtgattctataggaaactaagggacctccttatcacccttctatgaactatgcccctgtcagctttaaaaatttgttgttgttattccaatttttttttttttgagatggagtttcactcttgttgcccaggctggagtgcaatggcacaatctcggctcaccacaacctctgcctcccaggttcaaaccattctcctgcctcagcctcctgagtagctggaattacaggcatgcgccaccacgctcggctaattttgtatttttagtggaaacgggttttctccatgttgttcaggctggtcttgaactcctgacctcaggtgatccgcccgcctcaggctcccaaagtgctgggattacaggcatgagccagcacacctgacctgttattccaatttaacagttctttcttcccatacctgtaaatgtgtgtgactgtgtgtgtgtgcatgtacactcacacacacacaaatacacaagttcaagtgaaatctaaatgcttggtaaaacagtccatgtgcactaatttgcaagagttgttgtgagggtagagcttttgaataaacataggttgtcaaaggaaaaactccctctgtgtaagccacaggacaaaggttttgaaacacctttgttatctaaagctggaaagaaatgtcttgccttaaaagaatttgcacattcgtacctctttccacaaatacgtgaaaggacgtgcttttgaagataagaaaagtttaaattctacaaaaaaaaaaaatctgatttgggcagaactcattgctcccttttctctgtttctaccttgttcttctctgggtggatcatttactacttatactgtcagtgttggtgttgcttgtttacttagatccctgaagtcgagttgcacaactccagggggcattcagataaaatatcatgtgaatgatgccctggagttttgcaggtagctttgtcctgaagacagggacaaaaatgtttcatctctttacctcccagtgcctggtggacatgccttcggaccaagtagttgcacaattcattgttgcttagcaaatgaacaaatatgttcacctcactaaatagctgacatgaaaacattttaaaaatagtatcaagatatttaaacagtcgattttatgaatttaaaagacacctagagatactacaattccgtagttttttagattaaaaaacaaagacccaaagtctatattttttaaaggaaggcccagatggttttgtgaaggtcatgtgagtatttagggacaaaactagagctgaaactcaattctcttggccccaggtgatcttctcactccaccagacttactcagttcacatcacagtcacaattcagattagagctatgaacaattctatccatttgcacaattctaactggtgtttctaacttcattaaaagactctgaattatttttcttatatacctctaatcaagatcatttggtattatcctgcatatgttcaaatgttacctatctacagatatttgaacttaggtggggaatatctccacaaagtccattaagtaagttcagttttagtgaaaactgagatggtgcagcttgagagattaagtgtagaatttccaatgtaatgctttgaatgtgtaccttaaatctgtatcactggcttattctgggaattgaagtcttatttcatttctcagagaatgatggttctgctaccagtaatctttaagggttagatcattcgggttttttgtttgtttgagactaaataaatgaagaaaacacatgttagatacaaaacactagaaatatattaattttcactggagcgacaccaaaggccatcgacattaaaaatgaactcctaagttctttgcaattccccaggtatagatttaatatacaacacatgcatctcttgaaactctttctttgctagtaagaattattctcctgaaatacccacctgtcaaaaagaaaggtaacattattgatttttagaattcttatttctgtcgtgtcagtaagcaataccggaaagaaaatcaaacactcaggagaattggcatgatggtgaaggttgagcttacaagtacagtggactcaagtatccatgatccagcgcactgagcaataaatccaaatgagcagtgaccacaggaaaacaatatgcagggaggcctcgctgggaaaagctaaacttttatatatgggaatagtctatggaggattacagggatgttttcttgggggtataaggtctggagtgtgcagtactgggtgaagcccttatctaacaggcaacagaaaggtcttcccaggttaggcacacgtgactctacctccaacacagaatttttttttttaagaaagcaacagaaatttgcaaatgatagtctggtcttttgtcctctcaattttaaagcaaataaccagtattgtgttatctaccttttcatggatgcatccagtgtgcctagaagggccagactttattctgtatttgcaacaaaagtagacccagcaactgatgggaagatatctgattgggaagcagaagcagctggtattttaaatcaggatgaaagctaagattttaggactcacttttgataggaagaaaggatatatcaattttccttttaatgagtgggatttttgaggtactttgtggggcctctggttcaagactgtggccagtgtggtgttgtaggaggggcactgatggagagctatcccggtgcattatttctgagccacctctgtgcactttacttcctcatttgtaacatgggactaatgtgccctgctgagtcctcagagttgctgcaacaatcaaatgagctattaagggataagctcttttccagctacctatgagaatgggtatgatatggtcccagaatttgctctctagagccacagaaatctcttaacccctacaagaactctttaaagttgttatccccattatatagatgaggaaactgagacttagacaaaaagttgtccaagatcacataatattaaggaacagagctgggatgaatatttgagtctaattccaaaacattctggaataactcaatatgtggttttccatttctcccaaaaacaggtacctgcttttttcagtggcttgtgttccagctgacagctccagggcctgtttgaataattcgaagacaatccttagttaggaaagcaagctttaattatcactggggaacagaaggccgcatcttcgaggaatttggcagacctcagcagggggcaaccacaggcctttggcaaaagatcacttttcaacaacattgtcaattccagtgacccccgaccttccacctgcaggtccctgaacagctgctgttctgtgggaagcagtggcagtctgtcttcctttaaaaggcacatgcacactctgtccctgctgcctgctgagatcccacctgggacctcatccccagagctgggggtcatctcccatatcaagaaattaagaaaaataagggggggcaggaaaggacagctttgacaacagtccctgaactttcccttttaatataagccagatttaacgtatgtcattctgtaaatccgggagtccaatttgaggcttgtaatttgctgcaagcttccctgttcctccaagtggggtggagctatgccaagcacatcaaggtaactggtggaagatataatttccccactgtgagcctgcatttcagttccctattgtaatttttatttgtgttgaggttttgtggttttaaaaaagtcaaccagatttatttttaaattaacccagcccaacatcaaaggcaataagtagaggatgtttaggtattataaagaaaccctgtgtaatctgttatagctgtattctttctcagggcatgtaatggtaaatggttaggggcctttcacaaccaactttctatatttctctgacctcggactaccctcatgggcaaaaaaccctttttgaggggatttagtagcccctctctcctcctcctcaacctcttaatctaatcctgtttgtaacgcaacatgctgcatgaagaatacgaaacatgggcttaagtccctccccacttcccttatgactgtggtttacttttagatatgaagaactctttcaggccaaaaaaaaaaaaagggggggaccatttggttaacgaaccattttctttggtaggcaggagaaagtttatattgaaagtttatcttaaggatgacaggtcatacctgaagggtttgttttggaatactgtggattttttctaacccaaataattacaagagagttccttgtttattggctcatggaggaaattcaagcgcctctgttctaggcattttaagtgctctgtatatatggtggttgttcctcaaaacagctttgggtttgttttttgttttttgttgttagtggtggttttttgagatagagtctcgctctgttacccaggctggagtgcagtggcgcaatctcggctcactgcaccctccacctctctggttcaaaagattctcctgcctcagcctcctgagtagctgggattacaggcgcccgccaccatgcccagctaatttttgtatttttagtagagacggggtttccccatgttggccaggctggtctcgaactcctgacctcaggtgattcacccgcctgggccttccaaaatgctgggattacaggcgtgagccaccatggctggcccaaaacagctttttaagaaaagtgctattaaccccatttacagatgagcacatttgagccacaccctcttttccacactctaaatcttgtctctttctttaaacatgagttacttatacttctgagcataactgaggcacttttagagacagtgtcttctaagctcaatgtgatattatttgtgctgctgtgctgctactgggtaaccagcacccatcctggtcaccagggtaactttgtcaaccaagaaggccaaggatcccaaaccagcattttctactatcaaaagagaggttctgcaaatccactggcaggagagaaaatataatagcaggtggcatttatatgacccagtgtgcatggcagtgtcccagggtatcaccgtgaatctcagaaactccaggctttccccatgggaaatccacaccaccacagatccagtggaggactcggtcaagactcctgaaatcaaagaactcacagtgactgattctttccctagttttataatataaataatggcatggggtcacattcagccgtcattatccacatcatttcactgatgggatcctcctcagacagagattgggaatcagatttctcggtcacataaactgttgctcattctgtgaggctgcctatttgtaaagttgtggttcttattaaaagcaatctcagacgtagcaagcacccctcacttcccttctcattcattttgttaaagcaaatgggctttggaattcaggcctgtttctaccacttactaatgttgttaatttggaggagttcctcaactttgccaaggcttgattttctctgctgtaaagagggaataataaacctattttacagagcagctgagacaattaggtgagttaatgtatataaaatggtttgcataatacccaacacatattaaactctcactcggtttttaatattaacctctatgtgcttaataacattgaagaagaagattcaagtagattatagtctgttaaagagttcaaatataaataaataattctcagggtgagaattgccatagcatagatatgttacgtacccatggcagagcgtgaggtggcagcatctaatggttgagggagttgggtgagacatcaagagaaggtgacatatttttttgagtacccagtggaaggcatgggataccatgtggatctctgcagtagattaaatatagacttgaactaacctatcctggaacaataggacaatatccttgtggcttacagaaattattccctgcacctatattgatttgtttattaaacgaatagctttattggtaaacatgtatattgcggaagtagacttggttatcattcccacaagtccagttaaagtaatggcatctatataaaaaactcataaaaactagatatgtaagtaatcaataaaatactcttctcaagtattcaggagaaaaaatgtgttgaaatgatgattcatcattccacataacgtatttgtgactacatttaatagcctcattagcaataaaatttttatgagttaacatcatatgaggatattcccttgtaccttaccgagactttatctgtagatttgtaacataaccataatcatcttggtatgtttcttacacattttattcagtgaacccaaatgaacttctaattacatgttcagctgccagtcatggttttatatgtttgaatatatataccttcagaggatatttgctctttggggtggtgaagacttcatcttcttataaatgcaaacagaagatagttggaagaggaaaatgttttagcagtgtctcaattatctctccttaatgattatttcacaacctcgagatattttcctaaaagactaagtaagaaatatatagtaagattcctttctggatattttcagaactcctagttataactatgcaccaaatatggataaacactggattatgcagtacacaggaccaatgctgcccatccacatggaatttacaaacattctacagcgcaaaaggctccagactttgatgtcagtggatgattctgtggagagggtaagcacatgaacctacctcagtgatagtttttggcccagcttcctttgtgtagacttattcttgccaatcctgtttggttttttccccttcattttccagcatcattttgagagagaaagaaagagagagagtatgtgtttagtggcttaatcatccctcccttatcttgtcctcattccatctacctctccagggttggtttcttatggagccagtaaaaaagaggagagaaaaatcaaatcagcgtagatcaggggccacatcctcaaaggcaataaagaattgatggagcttgtgctgaacttgaactttaagttaagggccccatctaaaggaacagcaattactcagctccagctaaattttgccatgtagaaatgtggatcaagtatcagcaggtcttctgacttttttaaagaagccagaaacacaaaaaattttatttgaaattttctgaactttgaaacatagtataagccaaacaagacgtgcctcaggctggatttaactggatcaggctcagaagcagcctgtttttaacccttggtaattagatatgtgatgataattttaacaatggattttcaaagtacaacctataaagtttgatggtagaggttgttgtgcggggtgtttttgtttttgttctaccaaacaagcaaacaaaaagcctaaaagtagaatgtgctagattccaaaaagttacatttcacctttaccattggacctttccctcccagactgtaagcaaatagaaaatgtggataatgttattaaagcaactcttgccttttaaaaataacaggaaaaagatttgggggcaatcgtggcaacactattgagcatcatcttataccagcacaattgattctgacttgttcctttgctgtatttcagctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtacgtatttctctgtttgcaacattcaactgtcgtacctcaagtgtgtctaagataattcaattaccagtctcagtatctggtttcctttcatccaaaacaaaaaaggatgtgtgtaggctggttaatttcgaagatgaaaaccttttcctccctgccacatcttaaattagctcaagtatactacttaaagagaaaggaaaaataagtgtatcaatgactaattctctcaaattgactggaatctatgtctttttggtctgtgtgcacagacaggatgtgatcttctgggatatcacccttctttgaatcagagatacgctgtcatttaaaaaaaaaacctgacaccatccttttagtgtttaacttttaaaaattattccgaaagaaatgtttttaaaagataaattttgaaaagctggcttttcttttaaaggaaaaagagctaaaggactaggctgctatttctgtcactgtaggcaggtcactgcttctctttgcatctctattttcccatcatgaaatggccttgcctattttcccatcataaaatggccttgtcaatcatctcaggatgttttgaataaaatgggattgcatccatgaaagaattatggaaagactaaaagaaaaagtggaagtagaatccagaagctggaatggcccttgaaaagcatctagcctggacccctgatgtaacagtgaagctaggcagacagcgtcagtgcccctctcagatccctgattctggaagtggtggcagtggggcccagagcccagatgttctgaatctcccccgagtaccacatgtgctgctgcatcatactacatcctggagagagggcaattgaagtaagaaaggtttctttgaagaatgttattgtgcttcctaagattattagaaacaccctgagaattgtcagatctatatctagaaggctttatgttttaaggactagatagcatagattgaattcaactgtaaaaactgtacatccttttttaaaatattgattttaaagctcttgttcaacggaaaagttatggactattgggttttaagcaaaagtatgcttgctgcaaaaaccatgtatcaggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataatttttttaacaaaaggaactttgagcatgtaaaatgaaacatgtatgcccaaattttgaaattaatgcttttgggaagaacgaatcttttcctgacctctcatcttcatcctacccagtttgtcattttcataaaggacccatcaaatgttgaactcctgtagacagagctttaacatctatttcttgctgtttaaagaatgtggagtcatgtgacagggtaaaaaaaaaaagggggcaggactcagggaccgtaattcagatcacttctcatgtacgaagcttttccctttttgtcgaagcaaatttctacgtaagaaggaagaatccagcaagaatatccaacagtcaaatcacttgcccaaatatgaacgggtcaaagaactatgccagcaggccaggtaccagacagcctgtgaacaaccggggcaggtgagtgacgcaggctttctttaccaccactcatgtgcttctccatctctaatttagaaaattgtccacatataaaagaatgtacatttgtgtataaataagcttttcctagtggccttgagggcaagctcactgagacacctctccgcggacagaattacgtaactggttcaggctgggcctccccattactacttgggctccctccagttaaaaaagatgatgatctcagagaaagttctatgccaaaagacactggtttcctctgaggagaagattcctgttatagtccctgttaactagtcactgaagagttgccaaaaggctacttagtcaaagcacaggtacgtgctgagcctcttggcagtgaaccaccccaagagacatgatagggccttcaccctaggctaaagtcagaatgtcatcttacccccagtagaggacagagcctgtgaccaagcttgaggaatgagaagagaaaccatattctgtttgtttattgttcctacttctgctcacaaagattctggcatcaaatatttcattagaatagatcctcttcgttagtagaaatattactatagaccccagagctacccagaataccagttattatcagtaagaataaaagaaatactgtgtgatgaattaacattgcttttaaagaaagtgagtacgtatgaatttaaaccagtttaaaaccattgattttaaatgcccttgattgaaatgtatgctagctaaaagaaaatgctgtgtcatgacaagaggaactgaactttggcccaaatcattgcagctgagaacaaaatcagaggaaagtgaaaaatactaacacatagtgagcatttgtcttacatcaggcacagtacgcaggattttgtagcatttactcaatttaatcctcacaactgtagagtgaggtgggcattggcatctccattttacaaatgggcagctgggattcaaacaggagttgtctgattcaataactcaggccacttgctgccttccaaggtaagttacaataaccaggtgaagagaagttcaaatctgtgagtcttttttaacttaactgacctctagatatccacacaattcaccaacaccagttcaagatgtcaggctcatggaatgagtaggtaacaaagttattattaaaatggcctcactcattatacgcttattatatggtatctagcttgttgaatagacattcctaataaacaacttgatccttataccctgcatttcctcatgctttcttgtacacaggatccctttgaaatagaagaggatagggagggagagctgttgaaggaagggctaaaactaagccttcactacattctagtacatcttaattttcaagtgtttagtggagaaaagctgagacctattcattatattttaatttgaagtcttcaaatctttcttatgaaacctccaaatattattatgaataaaacctcagaattgttttgtagctctaagatgatttttatgagctagcctcaatagactaatttacttttattcaggagttgcaaatgttcagtgttaaatatatctcatgcaaattggtgatcttgttactcttttagctctaagaggtgaacattatagccttttgggaataaggtacactgcctacatttcagtgtgtaattttacaaacctctccatatggcttgccctaaaattttaatatatgtcctaaagggcaaatgtagcataaaccagattatggtactttggcacaagcttttcactcacgagctgaatgctaactaagttacaaacttaattttgctttttcatattttttgaacttgttttggccccatgaaatgctttcatatctggaattttcttccactgtttcatttcgctgtgaatcagtctgaatttagatccattatgtggatatatgagaacgtcagcaatggtctcttttagaaaggcctgaattcgtggaacaaagaattaggctatgccctgatggtgatttctttctatagaatttctttatattgggcctgagtgagctttagaagtgaagacctggagagtatttcagattgtctctagcttcagtgtatccacagcactagtgaattgttactctaatcccgaaccagcaggatcagcatccctgagagtttgtcagaaatgcaaattctctggctattgcagaccttctgaatcagaacccctaggggtgaagcccagcaatctgtgtgttaacaagtcctccaggtgactctgatgctccctaaagtttgagaagcactattctaacccacgattgtgtttactggtggccctcaaaccatagcttaggaatctaagaacttcaagaaaattttgagccttaatctttaaagcagttattgaatctgtgggtcaaacctgatagctgtgttgtgtgttgttgttttgttttctttgggacagggttttactctgtcacccaggctggagtgcagtggcgtgatcatggcccactgcagcctcgccctcctgggctcaggttatcctcctacctcagcctcctgagtagctaggactacaggcacacaccaccatgctcgactaatttttgtgcttttttagagatggggttttgccatgttgcccaggctgatctggaactccaggactcaagtgatccacccaccttgacctcccaaagtgctgggattacaggagcgagcctccatgcccaggcagctctgttgtgttctatcgactttttatatcttggccttttgctctttctttctggctactttgaagattatctgtttttggcgacagtatccctgactttaaaaaaggaagaagaaaattcagaataatgacactgaattgttcaggttcgaggtggcagcggaggctagaactgacctgcttggaatctgctctctctcgatgtccctcctgacatgcgccctgcttccgttcctcttaacaaggtgaatggccttcattccaaggcaacacagtcaggttttgacactccatggggaacaaagggaaaatcagcatgactagccccattctcttcactcttaatcccagagatagtgaatgcccccctcctaccacatctttgtgccaggtcacctaaaggttgtttggtggagtcaatgtgggtgcatgaggtaagtcaacagagaaaagagatccaaaggttggggttagaatattggccgccaccactttctagttgtgtcttctcaaataggtcacttactttctcctgagtctcaggttttctatctctaaaatagagaaaattaacctcacccttgtgaggattaagtgatattatacatgtaatgtactaaagtgagactgagattttctctagtgtgcgaatattgggtgttattattattccaagccatcttacctgctgttttcattcctatgaagccaattagaattaaaatgggctgaggccgggcacggtggctgatgcctataatcccaacactttgggagcccgaggcgggcagatcatctgaggtcaggagtttcagaccagcctggccgacatagtcatagtgaaaccccatctctactaaaaatacaaaattagccaggcgtggtggtgggcacctgtaattccagctacttgggaggctgagaccggggaatcacttgaacccaggaggcagaggttgcagtgagtcaagattttaccattgcactccagcctgggcaaaaagggcgaaactccatctcaaaataaataaataaatataaaaagaataaaaatgggctggaatcccagagacttggcatcacttcttgactatgtgaacacaacaaccagcggggactaattaagacaacatggacatatgtgtttgcattacttccacgttcctgaattaatatgagatggagtgtgaattcccaccactctctcagctgggcgttacacccccggacacgtttatgtacagacactccccatccccctacaccatcacacacatgcacatgtgcatactgaggggcaaatctcgacctctttcttaaagcatgtttgttccacagagaacaaagagcagtgatgctcaatgctggcggcacattaaactcacctggggccgagcacggcagcttatggcttactcccataatcccagcactttgggaggctgaggcaggagttctaaatcccctaagcccaggagttctagaccagtctaggcaacctagggagacgccgtctccacgcacaaacaaaatagccaggcgtggtggtgtgtgcctgcagtaccagctactcaggaggctgaggtgagggaatcgcttgagcctaggaagtcgaggctgcagtgagccgtgatcgtgccactgcaccccagcctgggcgactgagtgagaccctgtctcagaaaaacaaaactaaaataacagaaaataaaaaataaactcacctgggtggcacttgaaaaatgctgatgcaccccccagaccaaccaggttaaaaatgtctggaagtgaggccaaggaatctgtattttttaacgaggttaagaatcacaggcctagaaccagagaatatcaaagtttgaaggaatcttagaaatcttctaagttgaatggtatcatttttctgataaggaaatttaggtccagaaaagttaagctacaaacccaaagccaaaacctgcatctcttcacttcacgttgagtactttcttccctgtaacatgctgccactgcaaaattgcaagacagattttccctttgaaactatgaatggcaatcaccactcacggtggttctcaaccctgactgcacgttagaatcatatgggcagctttagagatgcttatgtttaagtcccagcccaggcaagttaaatcagaacctctgggtatgagacccaggtaccagtgttttttccaagctcccctgatgattcctacgtgcagacaagcttgagatccacaaatgtcaagtgagcattaatgggttggtttttcttcttcttctaggcataggtattgacgtcttaaataggagctacataaaagagaaattccctgggcatccaattttgaaatacactttacatattatctggcatttaagtggaaaaaagcagcctgctttgttttgatagggcaaatatcacatccttttgatgagttgttgaattccagcatctttacaatttagtttgcctttctactattggatcaatataaaatcaaacatttgtttaaaaatctgtgaggacccctgcatcaagcaagctgatgctattataacggaaatagaatgtagtttgttgagtggaaactggtttagctccaggatggatctttgttcctatacaaaacttatctctctggccgtatatccttctgaccctttgtgaccagcagcagagcatgaataataagacatttaccatggagatcctcctagaattgttagttttccagaagcagacaaacctgtttcccaaaactcactgaactctggtcaaaatggcagcatggctcatagacatcttcccctggctaacctgattccagagggcacatccagaaggattgagctcccagtgccatccttttactgaattctcctctgtgcatgggtccattgtggaccactcagcctttaaaccttgcttccttccctcttcaacccatgctgaagctcatgtatgaacagttgttcatctaattaaatctttgacttctgtgcatttgttctaaacaagtcaaaaaaagacaaacatgagaataggcattttactcataaactgtataatacagccccattctgcttaatttgtactgtgtcttcttttccaccatttcctaacagcccatcctaatcaggtcctcctctatgtttcttaaatgttacatgtgaatcccactttctcacttgcatggaggttgttacttctctcttctcacctaaggctcaggtcctcctctatgtttcttaaatgttacatgtgaatcccactttctcacttgcatggatgttgttacttctctcttctcacctaaggctcacctgaagactcatactgccttcgtaccattctccttttcatcagtatcctgatcaaggtgctttgggattacatcctggatatactgctttcttggcatttgcctatgtgcaagtttcttaacctaactctgcctcagtttcttcatctgtaaaatgggcatcatatagttcttgcctcataggctgtggtaaatgttatatgaattaaatgtatcaagcatctgggacaatgtctaggacatagaaagcactcaacaaatgctggttgtcaatcattggccaagatcagtttaccaatttcattttctaggaattacaataatcatacatcttccaacattccagtgttgacttttacaagggattatctagattaaaatctataacaggtaacatttctctctcttctgcttctccttttctgttttccgtccccctctctttcccatcttacaccatctcaaagaaaacaggccaggagataaatcctcctggcacaagtaacactaattcatatttgtgagagaaaatttgacaatgacttgagctaagtagcagtttggacaaagatgtgaatatggtctttgtatattccccagtgttaagataaatattttaaacacatgtccacatgcaggtaacttttttatgatgttcatgttggcatgaataataatcagtttatcacaaaattactatacagttgtgacatttcagagaacatgatttgacctgcattatggccaaatccatgtcataagacatatggtaaccaagaactagtgtgtgtttatgtataaaattaagctttcactgcagtgcacctttgaaaaagttgtacacaatttttttaatttttctttttatttcaatagttttcgggatacaagtggtttttggttacatagataaattctttagttagatttctgagattttagtgcacccatcacccaagcagtgtatactatacccagtttgtagtcttttatccctcacctgcttcccaaccttcccctccaagtccccaaagtttattatatcattcttatgcctttgcgtcctcatagcttagctcccacttgtaagtgagaaaataaaatatttggttttccattcctgagttacttcacttagaatagtggtctccagctccatccaagttgctgcaaaatacacattattttgttcctttttatgcctgagtagtgttccatggtgtatatataccacattttctttatgcacttgttggttgatgggcatttaggctgggttccatatttttgtaattgctaattgtgctgctataaacatgcctatgcatgtgtccttttcatataatgacttcttttcttttgggtagatacccagtagtaggattgctggatcgaatggcggttccattcttagttctttaaggaaactccatactgttttctgtaatggttgcactaatttacattctcaccagcagtgcaaaagtgttcctttttgccacattcacgccaacatctattgttttgttttgactttttattatagccatgcttgcaggaataaggtggtatctcattgtggttttaatttgcatttccttgatgagtagtgatgttgagtattttttcatgcttgttggctgtttgtgtatcttcttttgagaattgtctattcatttctttaccctacattttgatagaattattggcttttttcttgctgatttggttgagttcctttgtagattctggatattagtcctttgttggatgcatagtttgcaaatattttctcccactctgtgggttgtctgtttactctgctgattatttcttttgctgcgcagaaggtttttagtttaattaggtctcattcatttatgtttgggtttttttatatttgcttttggggtcttagttatgagttctttgcctaagccaatgtctagaagagtttttccaatgttatcttctcaaatttttatagttttgggtcttagatttaagtctttgatccatcttgagttgatttttgtgtaacgtgagagataggaatccagtttcattcttctacatgtggcttgccagttttcccagcaccatttattgaatagggtgtccttaccccaatttatgtttttgttaactttgtccaagatcagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttgcttaatattgttttggtgtagccaatttttgggttttttttttttgtttcttactcatgaaaatggacacaagtaggcataagtaagaacagagaacaacatccttaaccaatctgagaaatatttgcaattcaaaatgcagaaattataatgattacttagtggatacttcaggaaggaaaagcaaccagaggtcatctaatattgcactaagtattttacatggaaaactgttctatgagatacatattatgcccattttagatatgaagagactgaaactcagatgggaaaataacttgaccaaagtcacacagctagaagaatgacaaacctgagttcaaaccaagatctgggtgactcaaagcttctgtctctctcactaaataataattattttgtacagtttaccaccagaaaacattagcttgcccaggattggataaactttttaaaggccaattatagtactgctctaggttcatatagtacatcttttccttagaacttcaaaacactcaaacaatctattctcatgactatccatgaagccaggaggagcaagtattattttatcggatgtggaatccagaagaacaaagagattctgcaatttgctcaaagccatagagttagcagcaaaaaaaaaaaaataataaaattaaggtctttgaatcccaacccaatactcatctccattaaaaatggctacctcttatcaaatacacattagatcacattctttaagtaataaaccatgtgtgggtgtatgtatgtaataataataataatagcagctgcttttgttgagtgcctgccatgtgctgagttcttaccgtgtgttatcgctaatgctcataactctgcaaaggctaatgtggcatagcttacttgctcagggccacatagccatgtgatagagctggtgttcaaatccaggctttttgagcttgcaaatccagactttttcctttaagccacaccgatgagtaaaaaacaccattccgagtccaagacagaatataggtaatattcactactacgaaatcctatttcagtaaatgacttgtgacagcactctgggttgtagtgaggattaaatgaaaaattcataaagagtgctctagagcagtacctgctatcaagcaagagttaaataaatgatcataatcatggtagtcaagatgatgatgaatgaaattgtttgaaatgcgtttgacatatttctcattagatttgattccaccaaactagctgcacactatttgtatcctcataccaaaattgccagccttctcttcttcatcaggtgttatttatatacaggcagatataatcaatcaaaaacactaacacataattacctaaccaagtgattctgtgctgagataacttctgggaatgactcaggaatatgagacatggcccttgcccttaattccaacttccaccatagttggaaaggctgaaagaaaattataacaacttaagaaattatttaaatagttttatctagcacctcacccataattgctgtgcagaaatatttgtggaatgactgtgtgctaaattattggcacagactgataaatcagacagaaggagaacggaaataatgtagttgcagaaaacaggaaaacaatttgcagaaggaatgaaccatcagtgaagatggagacaatcggatttggcaattaactgatttactgataaacttcaagagcatagataatagaaagacagtgtgacagctgtgtttctgcaagggcacttgttgaacaaagctcatttctgaggctgactccacacatcccattagcaggtgcctcacctgagctcaggctttcatctgattcctgaaactctcctgcaatgcaaaaaacatcccttctcattattttgactatttaaatggcttgcttcatgagtttcagagcaattcttttaaaaattctctttatctgcttccctctataaactctctaagatcaccactttagttgtagctatttcaaggttttattgtgcagtcataaaaattgtcatgatatcgagttctaaaatggctgtggcaatgtgtgataattacatttcattaaaattcctagtatgcttgccagtaggaagattttcaaagcctctagttaattactttatctaacagggtctatgactttttcaaagggtccatggtagaaaaaataattgacatttttgttcatggctcttgcttcatccaagtatgtgtgtagatatatgtatatatgtagtatgtatggataatatgtttgtatgcatgtgtgtagacatatatgcatatatgtatgtatatttgatttcgtatgatacatcatcatagccaaggacagtgccagacatccagtgtggttaaattcaactcttcagaaaggaaacaccttttcccttcatctctatcccataggaaaccaacaaagaatttggctaatgggaaattcaactaggattccaaatagcctaagtcactaaaacttctgcctacacctttgtgttctacaggaatctacttgtaccctcagctcctccagggcaaaaacaaacaaaataggcagaattctttgaatgcattgtgattataaaaaccacaggttttcactatagtcatgtgctttaaaaattagtatttgtactaaagttgatataaattggatccacaaaaagactttagaccattatttttcaagaatatatatatacacacacatatatatgtgtgtatatataatgtgtatatatatacacacatatatgtgtgtgtatatataatgtgtatatatatacacacatatatgtgtgtgtatatatacatatatatgtgtatataaatatatatacacatatatatgtgtgtgtatatatatatatatatatatttttttgagacggagtcttgctctgtcacccaggctggagtgcagtggctcaatctcgggtcactgcaacctctgcctctcaggttcaagccattctcctgcctcagcctcccaaatagctgggactataggcatgcgccgccacctggctaatttttgtttctttgttttttgtttgtttgtttttggaaacagaatcttgctctgtcacccagcccggaatgcagtggcatgatctcagctcacggcaacctccgcctcccaggttcaagtgattctcctgcctcagcctcccaagtagctgggactataggcgtgtgccaccatgcccagctaatttttgtatttttagtagagacggggtttcaccatgttgtccaggctggtcttgaactcctgtcctcaggcaattcacctgcctcagcctcccaaagtgctgaaattacaggcttgagctactgtgcccggccgttttttttttttttttttttctgtatttttagtagagagagggttttgccacactggccaggctggtcttgaacccctgacctcagacaatccagcctccttggcctcccaaagtgctgggattacaggcgtgagccaccacacccggcctcaagaataaaattagccatattttcctgtctgatagaagatggagcacctcttacgcttccacttggctgtggattgtgaattcactagccgattattttgcttctctaggcattaagcagtcaactcttcatttttaaatgctagaggcagagatcatccaggtagatggataagccttaaaccatttggatttaagacagatatacatacagacagacactcaaatgctactgattcccaaactttgcaaagttacgaaaagttatttattttggcaacactttccccagcaataattctatatagcatatagttatatgttaatggagttgtctgtcagtttctgagcccaggctgtagtgcagtagcatgatggcatgatctcagctcactgcagccccgacctcctgggctcaagtgatcttcccacctcagcctccctccaagtagctgggaccacaggcatgtgccagcatgcttagatgtatataccacaggcatgtgccagcatgcttagctatatatatatatatatatatatatatatatatatatatatatatatatatatatatatatgttttttttttttttggagagacagggtttcaccatgttgcccaggctgttcttgaactcctgggctcaagcaatccacctgccttggcctcctaaagtactgggattgtaggtgtgatccaccacacccagctctgagaacttttttgatcatttcttggcacatcctaaagctaattggatagccatgaatgctataattgggtctgtgagtgccacaaacccaggcctggaaaccactgatctccacattaaatggcagaatcatgaacaggccgcatgcagttttcagctaagtcaaaattctgtcacttatcaactaactgtggagacagcacaaggataactggtttcacttaaacaacgcacatagtcctgaaagcataggtgcactgatagtattcatccatccaactggagtcattttctgacctgcttacatcagtacatttctagacacagcttcctttgcacatgccgcccccaccaattacacgcatccctctcaaagacccatgcatctgagctacttagacttaaatatatccctcctgccttccccatggaatccagctgcaaaactgtccagtaagcagttgctaatgtaaagcagtggcctgaactccaactgcacattagaatcatctggggagcttctgaaagtccctctgtccagccaaatttgagaaccactcatctgacctaacttcctgtgtttaattaagttgacttcacagtttttaagttaaatcatctctaacttagtccttaggctgttcttgtttgtgttgcctttttgtggctttgtaagtaaaatccaccctctctatccgtgggttctacatctgtgggttcaaccaactgcagattgaaagaattgaaaaagaaaagatgatttcgtctgtattgaacctgcataaactttttttcctgtgattattccctgaacaatacagaataactactaattacatagcatttacattgtattagatattacaagtaatgtagagataaagtatacaagagtatgtatgtaggctaaatggaaatactacattttatatcagagacttgagcatttgtggattcgggtatctgcagggcatcctggacccaattctcagtggatgctgagggatgactcgttagtcgcctgtctgtcccttgagctcctgcttctctggatgaagatgctaaacgttcaagacatcctagccaatccacaaaaaaaggttgtaccctgatatggcttgaaacaaccaaattcagtagtaccaagagtatagggggctaaagcaaaatcatagaagaagtcctgtatctctaggatttggggattatatagtagaagccaaaaagcagctctgataattcaacatacattgaagacatacaactcccttaagagaaagcaaaccatggctctgcatcttggttcatcatgaataattgcatatcattttgtacacgagtgtcagttatcagcaaagccatctgggacctttggccaaactttactttgcagtaggacactttgcaaccaagatatcaccccaaatatgtactggtataagagggaggtatgagatccttttaaatgatgcatggaagaacatcttttatttaataattatttatttatttgaatatatttgaaaatatacgtggcacaaaaaaccataattttacagtgcagatagtattgttctgtccacagtttagaaatgcacccatttaaagaagagtttctcactctttaactagatatgaacaaaaacaataaaggataaagaaaagtttcagtagataatggtacacaactgatagacctatatggaaaggaaaaaagacaaaagtgtgataacactatattttaactctgtgacaactgtggccaacttaaaattaaatattcttcctgcctccccaattaattttgtagggagaagggggaaaataaaatgtaaaagaagttattcagtctttaagtaagatgtggaggatcccaggaaatgacccccagggtgaagagctattatttcagccaggttgagattcagtaagtgcaaggacacttagtccagaggcaatgtcatatttacttggatgtaagcctgcagcatctgtggcaggcatgttagaaggctcagtctagaaaagtcagtgcaagctccccgtatgtgtctgttgggaagtgaactctgtctcacatagcagcatgcccactctctgccgagtatgcagttgaaactgcagagttccctgatccccttcacaggatgtgcaacaggggtgtggcatgcctgcttggtcaccaccactgctcaaacccctgatgagagggggagcacgcagataggcaggtacaggaaccagggcgagtcttttgggctccagccctgcggtagtatctaggggcgggtgccgacggccccagtgttacaatgctcttttagccttgccgtctgcagacagcttgttaaccagttcaatggaccctctgccttttgacaagggtagagggccaatatgacagctttccgtattccaagctcttgcctagctcttggaagaatcaggtcacacacgggcttgaaggatgaatgcagggttttactgagtgttggaggtggctctcagtgggacggatggggagccagaagcagggatggagtgggaagatgatcttccccagtttggccgctggatggccacactcctctctgacccctagccaagctcctctcagtgttcagacgttcctcttctgtctttctctgccaccttgttccaccattcgtcagcttgtctcctcatctccttgtctgcttccggagcctgagtttcagggtttatatgggcacaggataggtggcatggcaggccaaaaacaacttttggggtgcaaaaacaggaatccctgtccccatttagggctgtagattcccgggcttgagggtgaggcctttgccaggaaactaccttcttctacccagggtttccctgtcttctgtccatatcacaatgttcttagaaggataagaaaagacacaaaagaaagcctgacaagtttgctaatgtctggggtatatgagagttggctcgccccatgatgggctccaattaaattcatctctgtcttcctcatgtgccattcttccctggctcacattagaaattcaggagcggagaacaaagcagccaagtttgtttttccagagcaagaggggtctggtgaaagcagtcctgacagctgcaccgtgtgtcttggtgaactaacggcttttacgtgtttcattcaagactgtttagtctgcgtgctaaggattcatatatcagtttttggctctagtgacattgaggtagtttgatttccaatgatttcgttgtcatctgtatttgcctacagtgaaagaaataactgagagtcgagttagtgcagggtcacttaaaagcttgcctttcttcattcactctccttaatgatattgccagtgcttctaaaaaaaagaaaaaagaaaaaaactaaggcagcagctcttaataaataacacctggagcagaatcggtaaactgctttcacgttggcttttgcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaagtaagccacgcttttgtgaccatctcaatggtggcctaggcctgtgggaataaacaatagagagacgaaagggttgctccttctacattttagatattatcaatgcatcattttcaggctaaaagcacatcattgctctatttaaaataagaaagctaagactaatgtgacattttgctttgtaaacattttcacttaagcatagaatgaaaatatagttcataaaagcaccagatgcaaaacatatgcacacataaaagagtttataaaatggttattccaaaaggtaaaggatatggtttaagtccattttattttatcgtaatgccaacatctcctgacttgtctgcctgaagttgcttttaaaaaatagtaaatacaaggtttcagtgtgtatgcatttaattttaagaggaaaagcataaacacttttttaaggcatatattttaatctctgttttaggacaatatatgtatgttttaattctgtcaaatcattggatctcgttgattggcagggacaaactagttgcattcagtatgaaaaatacttcctagaattttcttaatagctataagaaacctacgattatataaatgtgaaaatccacgggctgacaccctccacgaaagaatgaatctagtaccacctagtggagtaacatggaaaatgactcaattttatggtgatttctttctatactggtttggaaagaagcaatttaagtaaattaaattctatgtcaaagatttggaaatcaaatcatacactagaacaatggaagccctgagaacaggcatttttattgtagactccacaatatgggcttcagggccatgccctgatatttcatccaaaattgttgtgttttccatgtgtatatggacatttgtttccatgtcaacaatttttaacaaattttaaaggaatccgtaagccaaaatactaagaatctttgatttgggagactttttttcttccctaacagaaaaattccaggtctaataactcacacaaagatatcaaatttctgaaaatcaataaggccaggcgcggtgactcacatctgtaatcccatcactttgggaggctgaggcaggcagatcatttgaggtcaggggttccagaccagcctgaccaaactggtgaaacgccatctctactaaaattacaaaaaaaattagctgggcatggtggcacacgcctgtaatgccagctacttctcggaaagctgaggcaggagaattgcttgaacctgagatgcagaggtggcagtgagccgagatcgcaccactgcactccagcctggatgacagagcaagactccgtctcaaaaaaaaaaaaaattaataagggacgaggaccccagcatgctcttttttcagaagctgattagcaacattcagtttagaagtaggagtgccctcttctcttccagaaagttcgaccttgtttcccaggcactgggcataaggcacattgatttttcagtattaggcacaaacacaagtctagggcagctctctcaaactgtatggaatcttgtgtatttgagagcaggagtcggttttcaccctttctgcaaggatggaactcgtaagcactcttattgacacccctactgtcacggaggttgctccctgatctggaaactgcaggattcagctgagaggtgtctcagaagcatgacaattctgattccacagccagtatgccccacttctttctatgttagcagcaggctagagcgataaggccagacgaatatgcctctacagagctaagagcatctagtgtttgtgcattaaagttcttatctggtacacatgagttcttgaaaaggttccatagtcaccagaaagcatgctgccctctccccatccctgcccgcccaccccttgccttaaccctcctctgccaggtataaaagtgagttggctgatgaaagcattaacaaaatttaattcttcttagagtaatcctctactatttgtacaaatagaagttgtctagagcatttgcctctttgaaaaagcagcccaatgtagtggtaagacttcatagtctcagaagattatagtcctagctccataaccttgcaaaatgtatgtgacattcaaaacttcagttttctcgtccataaaataaggatgaaccggtattgacaatctgatgtttttgtatgtaagggtttttataataatacctgtctttcaagactccagattagagataaatatgaagtatataatacatagcaaaagctcaataaaggatagtcattattattaacaccataattgggaatatggttttatccaaaaaaatagcctgagcagttcacattgaaaaccaaatgtagaagttcacagcctgccatgaataaaaaggatcctagaaatcacctggactaaccccctcacttgacggatgaagggctggaggcccagagaagtgtgtcatccatcacactgccaggcaatggcactgccaggcaatggcactgccaggcaatggcactgccaggacaacctctgctaccgtgaattgcaggcaccacgatgccactcagcaatgcagcatggactgctttctccactccaggatcccttctggaccaggtgatcactttcttcccttgtaagctacatcaggacatccatagtaatgtatcttcccttacttctagagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtaagaaagctttatttgttcactagggttgagttcagaattaccaccacaacacaccatattatcaccattttgcacttggcaaaaaagcagtatcacttggcaatacagtgcctgagggctggcctatgtagcaactgggggttaaagaaacaatgagtccacgcaatcataggcttggacacatgctttgggtttgatttcacattaagactgatcagctaggaatccagccagagtaattcacattaaggctgatcagctaggaatccagccggagtaattccgtcacatcttgacttagcaggcatggagttcatgagcctaagcagttaccttcgcaggcatctagaaaacagatggaaacaatttcagaggctggaagttcttccatgttacacaatcactgtcacttggagcagttgtgtagtcacagactcagaaacgaaacacagtccaagggaggacagtgagtcccagagacgcttccagagagatgatgtaggttacaaatggatgtaagacatacaaacatctaaccagtcccggatcacagagagggccctggaagtcaaggggacagggaaggcagatgattccctcataagtttaatgaactcactttgttctttggctccatccaaagtctacttactctcttgattaggaaatgttttctttctgaatttattagcaagatctttgttttctctccctaattgtatcactttgaggagatgggacactgtgtgctctgccaggatttttatctctgaggctctggtctcctggtgcctgaagttgatgcagttatatactaaggggtttagaccagaatgcatttctcttacattattaaccccacatcccacctactgtctatccctggggctgtttgtttacttcaaaactcagtggggtacttaaggcactctctttttaacaaaatgagtggaatgaattccccttctgaatctgcttttcttcaaacaagccatttgcattatgatgtgaaaggtcccttttgttctatgtctatttgaacttgagttttttggtggtatcctgttcatgagggtgtgagcattgaaaactgccttgaaaagtggttgtagggatgatcttagtcacagagctgtgacaccatccacccatgtgacattttgtcctcactggtggctagaacctattgtgtccagaattggtgggttcttggtctcactgacttcaagaatgaggctgcggaccctcgtggtgagtgttacagctcttaaggtggcgcatctggagtctgtcccttctgatgttcagatgtgttcggagtttcttccttctggtgggttcgtggtctcgctggctcagcagtgaagctgcagaccttcgcgtgagtgttacagctcttaaggcagcgcgtctggagttgttcgttcctcccagtgggctcgtggtctcgctgggctcaggagtgaagctacagatcttcgcggtgagtgttacagctcataaaagcggcgtggacccaaagagtgagcagtagcaagatttattgcaaagagcgaaagaacggagcttccacagtgtggaaggggacccaggcagattgccactgctggctccggcagcctgcttttattctcttatctggccccacccacatcctgctgattggtagagcggagtggcctgttttgacagggtgctgattggtgcatttacaatccctgagctagatacaaaggttctccacttccccatcagattagttagttacagagttttgacacacaggttctccaaggccccaccagagcagctagatacagagtgtcgattggtgcattcgcaaaccttgagctaaacacagggtgctgattggtgtgtttacaaaccttgagctagatacagtgtcaaatggtgtattcacaatccctgagctagacataaaggttctccaaggccccaccagagcagctagatacagtgtcgattggtgcagtcacaaaccttgaactaaacacagggtgctgattggtgtgtttacaatccctgagctagacataaaggttctccgaggccccaccagagcagctacatacagagtgtcaattggtgcactcacaaaccttgagctaaacacaggatgctgattggtgtgtttacaatccctgagctagacataaagactccacgtccccaccagactcaggagcccagctggcttcacttagtggatcccgcacaggggctgcaggtggagccgtctgccagtcccgcgccatgcgctcgcactcctcagcccttgggtggtcgatgggactgggagccatagagcagggggtggtgctcgtcggggaggctcgggctgcacaggagcccatggagtgggtgggaggctcaggcatggcgggctgcagtcccgaggcctgccctgcgggaaggcagctaaggcccggtgagaaatcgagcgcagcgccggtgggctggtactgctggtacctccgcagccgctggcccgggtgctaagcccctcactgcccggggccgcaagggccggccggcctctgcgagtgtggggccagccaagcccacgcccatccggaactccagctggcccgcaagcaccgcaggcagccccggttcccattcgcgcctctccctccacacctccctgcaagctgagggagccggcactggccttggccagctcagaaaggggctcccacagtgcagcagcgggccgaagggctcctcaagtgccgccaaagtgggagcctacgcagaggaggcgcggagagcgagcgagggctgtgaggactgccagcacgctgtcacgactgccagcacgctgtcacctctcaatattcccattgatgctggtcttggatcagctcaacggttactgcatgtatcaacattaaggattttgaggattaaaatttctctttgttatctttagtgttttctgctattagaatataaacctatttcacatggttttggtttgttttgcaggtgttttattcttcccaatgactctatccattgtgagagagaactgtaccaatcggccagagcgtggaaggaccataaggcatacattgacaaagaggttagccatggctatgtgactgtcagatatattccaaactcaaactcggcctgccagccctgctgtgtctggtgggacataccacagatacacatcatctataattatgtgaaaaaatacaaaaaaaaaaagttatttgtctttctccagtgatttaatgatagtcctactgaaaacaatatagagtatgagaagagactgggaactgactcaatggtcttttgaaatctctgtgagaaaatgattcagttataaaagaggaatctgctaatgtttatctataacacatgggttggaatatagagtctatatagacatattctatgcccagtttgtttctatgttaagtatcatctcagatgaatagctgttattacagaacagagaaaacaaggtgaaaagaaaagtactttgtaaagaaaatcctgatcttaatacgtaagtgcttgaaaacatgttttccagattgaagctctgcaagataaaattaagaatttaagagaagtgagaggacatctgaagagaaggaagcctgaggaatgtagctgcagtaaacaaaggtgagcttgtttccatccatgctccactttccaaattcatttccgcacaagccagaggcattagcactgggctcatttttctctcttacctatagaatgtattgtcatagagtacgataacctaagctatttaagtaaaactaaatatgcttaaacttaagcagaaagtaaaaagtcacattcagctaaaatacttacaacatcactgccttccttctttctattttgctttctttttataaaatgaacactttgatccaatgcaaggctatgaagtctcactttttaatcttctctcctgcagctattacaataaagagaaaggtgtaaaaaagcaagagaaattaaagagccatcttcacccattcaagtaagtaactctctgttttccacatttgctgggagtcaatgactgtccacctggcccttcgaagaggctggagggacccctgtgtttcctgcagtgccgcttcagaagaagtagatccatctaggagggcacctagctcatgaagttgaaagcaaagccccacctcaccaagggaccgtggcaatgctcttggcatcctttgttggggaggcttgctgaactccactgtcattctgtgggtgctccctacctggcagatgggaccagtaactagattttactccatgcactgctttctgtggagagtgcttgagggttacagactctctcgatgcagttggtgttctacagagcagcctggaatagtgctgaattctgaaagtgggaagaaatataaatttttttaaataatagcaaaatttgcatgtgaaggagatttagtatttaaacttcaacaaagtttaagccttttatatataaaaaacaaaataataaaaaataattctaaaaaataaaggctatctaaacttgtttagtagaatttgtcaaagaattttttaaactttttaatccaagccatctgattcaactaacctttaactcgatggctgattggtactcggctgccaaaaaaatgagccatttgtccaaagagtgtggctagcaggatcctgtcattcacattaacatttatttccatcgatgtttccatgcacatgaggaggaaaatgttggtcctcttaggttcaataaggtcccaagaaagctgtcactgaatgcatttgcattcagtgttccttttttgttgttttttcgagacagagtctcactcttttgcccaggctttagtgcggtggtgcaatcttggctaactacaacctccacctcctgggttcaagagattcttgtgcctcatcctccctagtagctgggactacaggtgtgcgccaccacatccagctaatttttatatttttagcagagacagggtttcaccgtgttggccaaactgatctcaaactcgtgacctcaagtgatccgcccaccttagcctcccaaagtgctgggattacaggtgcaagtcactgtgcccagcctgccttcactattcctgattctattttaagtccctctatacaaaatgaaggtcgtccattatctcttatcaaggcatctaaatatttgtgcaagactcacagcaacaagcctatttgtaattgagaaagtgccttctgaacactcaaaataatcccttctcttggaacagggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccgtaagttgcttgttccaaatgccacttcctgccgccatgcagagacagcgactcataacttagatcagaaattcagcataaaatgaggaatctacaaagattcaagagaaaggcatcatattctactctatactggaaactcaaatgattttgccatgtattactgttttctttaaattttttctggcattttgtttggtaatgccaagcttctccctggctttttcctcctgatgatgttgtttcacataatacccagcacctggcacagtttttacccagtagaactgttctatagctaaataacgcaagggatgaacatcccgtaaatggatgaacaattttgccccaaatagattttgtttctgctttatttcaagtacataagtgtaataaaaggaagaaaaagaatggtaaaagcctcttaaatgcagggcccatactctacttattctcagtccacttcagtaccagcactagacttgtagaataatagatactctacaaaattatttggttttacattgaactgctaaggatatggcataataacatttgtgcacttttaaaatagtgcttatattttctttagtggcctgtgcacattattcactgaggccatatagaagtaataccccacattcttatagtacatcctctgattgaagcttaccagcctatagagtagatgaaacacaaaatcttctaactgagaagctcactggagaccacccgggctactgtttctcaaactgggatttggagactccaaagaattgatagaccattcttggggggatctagggcttgtcctaggagactttatgttttccctttccattttgatgtctcttgatttcagggtccatgtttgcatttctgtttaaaatcacatcgaggccgaatgaactcttaaagtcacagcatttaacttttaatctagtttctgaaactgtggtgtgggaatccctgagggttattcagatcgctggggacagtaactggggacgcaacatctagcaagacactttattttctgtgctcatattttaatggggtacaggtagaaaaaaaagaaagtaaatgaaacaaaataattatgagttgtagtaatgctatgaaggaaacagtgatcaacattgttttttattattatactttaagttttagggtacatgtgcacaacgtgcaggtttgttacgtatgtatacatgtgccatgctggtgtgctgcacccattaactcgtcatttagtattaggtatatctcctaatgctatccctcccccctgcccccaccctgcaacagtccccggtgtgtgatgttcctcttcctgtgtcaacatttttaaatgggactctttcggagagcgtggggaagacgggtctttgaggtgaaatttaggctgaaacctaaaggatagagagaagcgatccctgtgggagggagcgtgttccaggcagagggaacagtgcaagcagaggtcctgagggagtctcacctttggtttatccaggagtggaagctccttgaaagctgaagcattgcaaaacacagggttatagttgcttatggcagaaggaggcccttcatacctctatctgctttttatcatctgagttgaggccatcctgctcaagccaccaccatttcttacctcggccactgccagacctcctctgtggcctcccaggctcccctctggtcctcaccagtccatcctgctcagaggagctagggtgatcttttaaggacacctgcttttcttaagctaaagagcagaatcccttcacctgaccccagaaggctgaggcttcagtgagctgtgatcgtgccctcacactccagcctgggcgatagagtgagacgctgtctcaaaaataaaataaaatatagcaaaatccttaacatatccaacaaaaccccatatgctcctatccaatcttacactgggaccattgcctcctgttcttgcctgcttcagccactcaacttctctttattccacaagcatctcaagctccctctcgccatggggcctttgcacttgtttcccctccctggaaggctcttgcccacagccccgtgcccagaaaacactactcacccttcagacctcaattgcggtgtcactgctcgtggacaccctctctgtgcctcagactagggtccgcccatttgatacgctctatcagcaagctctgtttttcccccatgggacgtatcacatttgtaatcatagtttttttgactactgtttttgcttaactgttgtcctttccactagactgtgagtttctcaagataaaaaaccatgtctctatgatactgtattcctgacccaaaggaattgcttagtcaattttaggtgaataaataaacaaacaagcaagccaccctgtccagatcaaatcaactcatgtcaatttaacaaagctttgagtgcctgccactgggtgtcactgtgctggtgagtgaggaacgtgcctgccatcactctgctcttgtacacaggagcgaattaggaactgatcccattcaataccaaatttgatgctccttctgatacacaatgtattcttggtgctctggtattctaggacagtggcttccagaattttttcccaaaaagccacagtaaaaaaatgcaccttatatcaggatcctgtacacatatgtgcacatacacaagtatatatgtgtatctgtgtgtatatgtaatatatatactaaagtaaaaatttcaaaaaagtaatactatgtgtgctatgcttaaatatttttatccattttctattacatattttaataatattattgctgtattcctcatatttgctatgtcaacttaagcccttggcacagtgagactcaataacatgaaaaaaagaagaagaaaagaaaagtcaaatccacccaggcacaagatcctccaatgcaatggtctctaaacatttttttattatgtacccatatcaatttttaaaataaacacaccgtctatatttcattacactaatatacaaacatgcctgtgtattatgaaaatatacaaaataaaaaggccaagaacagcaattcatgcctgtaaacccagcactttgggaggccaaggtcagaggatcagctgagcccaggagttcaagaccagcctgagcaacatggtgaaaccttgtctctacaaaaaaatacaaaaattagccgggcttggtggtgcccgcctgtagtcccagctactcgggaggctgaggtgggagaatcacttgagcatgggaggtgaaggctgcagtgagccatgattgtactccagcctgggtgacagagtgagaccgcatgtcagaagaaaaaaaaaaaagaaaagaaagaaaaagaaaatacacaaaatagaaatgtaaagtttgagataaacgtttaaaaaagagtttttaaaaatagttttcatattctttggaggtccaaaacattttgttctcacttattaaagaatgcttaaggaaaacaaatctcagtgtcccacttaacaatgcagtgagacattcagtttatgtttgatgtgtgatcttaattgctttcatatgaaacatgactcagaaagattttctggttccatagatgtgcttcacggcatgctgagtcaatcaggacattctttttttttttttttttgagatggagtttcgctcttgttgcccaggctggagtgcaatggtgcgttctcagctcactgcaacctccgcctcttgggttcaagtgattctcttgcctcagcctcccaagtagctgggattacaggcggccaccaccacgcctagctaatttttttgtatttttagtagagacagggtttccccatgttggccaggctgacctcacctgagatcacctgacctcaggtgatccacccgcctcggcctcccaaagtgctgggattacagatatgagccactgcacccggccaggacattcatttatttatttattttattatttttatttttattatattttaagttctgtggtgcatttgcagaacgtgcagttttgttacataggaatacacgtgccatggtggtttgctgcacccatcaacccgtcatctacgttaggtattttttaatgccaccattaactaggcagtcatctctattgaaattacacttttaaatgtctgtcctccctgagattgatcaattattcttgcaaatacaaaggtattgtatttgtatatttcatgaaacaagtttaaaacccatttaaacggttaatttggaagatttctacacagattagaaaatttgggttccgtggtttttaatgtatgtagatgtgagataaatgttcacatataaataatatgttataaataacataattagagatcttttaatgaaaagtcgtataatgatgaaagcattttcaatcatccatttttaagatattatcttttcttcacctgtatttgatctaatctggttcattcaattcaatttaggattttttccccacagctaccccttcatatcgtttcctataagctttaggtctttctttgaaataagcatatgtagtttgttatctgatttgttaatatcaaatctcaagtattaaggctttttaatgttttgatataatttagaagttctttagaatagatggttttcattaggtgacattcctagaattattgtcataagttattataaatgtggtaacatattttacttaaagggtgcacatctattacaaagactgtttgcgttaaataaaaggtcagaaaggatatgaaaagtttaagagcgtaaaagttggctgggcacagtgactcacacctgtaatcccagcactttgggaagccgaggcaggtggatcgcttgagcccaggagttcaagaccagcctgggcaacatggtgaaaccctatctctaccaaaaaaatatgaaaattatccgggcttgcctgtagtcccagctacttgggaggctgaggtgggagagtcacttgagccccagtggaggaggctgcagatcacaccactgggcgacagagtgagaccctgtctcaaagaaaaaaaaagagagagaggcggagagaataaaagttttaagttggagaacataatgtgtaaaaaaaaatttttttctttttgagatggagtttcactcttgacccccaggctggagtgcaatggtgcgatcttggctcactgcaacctccgcctcccgggttcaagtgattctcctgcctcagctgggattacaggcgcctgccaccatgcctggttaatttttgtatttttagtagagaaggggtttcgccatgttggccaggatggtctcaaactcctgaactcaggtgatccgcccactgcagcatctcaaagtgctgggattataggcgtgagccaccgcacctgaccgtgtaaaaatatttaaattagctaatcaactaaaaacaaaatcattcctggagggagagagggttgaataggcagaacacaggatttttagagcagtgaaactactctatgtgatacaacaatggcagataaatgtcatcatgcattgtccaaacccagaggatgtgcaacaccaagagtaaacacaaatgtaaactatgaactttgagtgacaatgatgtctcaatataggctcattgattgtaacaaatgtgccaccctggtgagggatgtctatggtgagagaggttatgtatctgtggggactggggttataaataagaatgctctgtacttttccctcaaaaccgctctaaaaaatagtctattaaaataattttttaaaatcatttctcattcattgtttaaaacatctcttttagcctaaggggacagatttagtgtgtctgatactacataggatagcagagtctagtaattaagagtaaactcttgcccgggtgtggtggctcacgcctgtaagcccaacactttgagagaccgaggcaggcagatcgcttgagtgtcggagttcgagaccagcctaggcaacatgccaagaccaatctctacaaaaaataaaatattagccgggtgtgatggtgcatacctgtagtcccagcaccacaggcggctgaactgacaggatcacttgagcctgggaggtcaaagctgcagtgagccttaatcatgccactgcactcgagcttgggcaacagagcaagaaactgtctcaaaaaaaaaaaaaagtaaactctgtagccagatcccagtgctaccagttgtcagccaggtgaccttggacaaattacttaacatctccttgcctcaggtttttccatctgttaacatgaggatgataataataacctctgtctcaagaggtagctttggggattaaatgagttaaagtacatagtgcacaaggaatgctcattacgtgtacctatcctattaggttggtgcaaaagcaattgcagtttcagaccgtgaattttaaatcattataactgggctcaaacacatctttctcaatcaaaataggaaccattacacccaacgcattttcgccacgagaaataagtttgtttattcctgtagcataaaaattcatgtttcagaccgggcgcggtggctcacacctgtaatcccaacactttgggaggccgagatgggcagatcacgaggtcaggagatcaagaccatcctggctaacacggtgaaaccccgtctctactaaaaatacaaaaaaattaactgggggtggtggcgggcgcctgtagtcccagctacttgggaggctgaggaaggagaacggtgtgaacccaggaggcggagcttgcagtgagccgagatcgctccactgcactccagcctgggcgacagagcgatactccatctcaagaaaaaaaaaaaaattgtgcttcaggattcaatgaactcttggaaagcattttctacgttctgctggttgtggaagtgttttccctacagaaagttgtcgagatgcttgaagaagtggtagtcgattggcgagaggtcaggtgaatacagcagatgaggcaaaacttcgtagcccaatttgttcaacttttgaagcgttggttgtgtgacattcagtcaggcactgtcgtggagaagaattgggccctttctgttgaccgatgccggctgcagacattgcagtttttgatgcatctcattgatttgccgaacatacttctcagatgtactggtttggccaggattcagaaagctgtagtggatcaaaccagcagcaggccaccaaagagtgaccgtgaccttttttggtgtgaatttggctttgggaagtgctttagagcttcttcttgttccagccactgagctgttcatcgcacgtcacaatctgattaagaaatggttcgttgttgttgcatagaataagagaagacaacacttcaaaacgacaatattttttattttcctctcagctcataaggcacccacttaccgagctttttcacctttctgatttgtttcaaatgccaaatgaccatagaagggtcgacgttgagttcttccacaaattctcatgtagctgtaagaggatcagcttcaatgattgctctcaaggtcattgtcaacttccaatggtccaccactacactcctcatcttcagggctttcatctcctttgcaaaacttgttgaaccaccactccactgtatgttcgttagcagttcctgggccaaatgctttgttaatgttgcgagttgtctccgctgctttacgatccattttgaactcaaataagaaaatcactcgaatttagtttttgtctaacaccatttccatagtctaaaataaacatgaagagcaagtaatacattattagcaaaaaaataaagcaagaaatgcccattaaaatgatgattaatataaccacatttattgaagaatgtattccaatatcaaacagcaaatttcaacaatgcaaaaaccgtaattacgtttgcaccaacctaatagttgtttctaaaaaaattttgctgggccaggcacagtggtgcatgcctgtagtcccagctacttgggaagctgaggatcacttgagcccaggagttctagtccagcctgggtaacatagagagaccccatctcttaaaaaatacttgttaggcagcacatttctgaaattcaagaaaggtcagcaaatttggaacatgtgcccttttgtaaacagaagagtagatgagttgattataaatgggacatctcttctgcatacattctacaagttaaccagagggctatgtggtataaaagatgtttgtggtcacagcctagctcaggctagagtgttgcagagaccatcccaaatcctccaggctgggctcaaggcttctctaaacccttctttgttgcaaaatcccatcttttcatgcttcattggtgacatgtggccatctgccacatagaacaagtgagagtactagttccatatctttattaaataaccatttttcttttgtacaaagaataaatagaaattctgatatttttcttctcatacttccgtcactcacccctctttggaaaccactgcataacagagctaaggggaggataaactaatgtgcctgaaattttactttagtcttcagcctataagagatcactatcttttttcccattttcacctagtttcacagcaaatttacctacggggggaaaggtattattattcttaacatgaaaccacaatatttataagaaagaaattgtgaactttaaagtgtaaagataagggaacactggaatggcaagcctgcctaaggtttttcactctttttgttttgttgtgtttttcttttttacccaacagtgggatctttctgtgcttgcacgagttctaacaataacacctactggtgtttgcgtacagttaatgagacgcataattttcttttctgtgagtttgctactggctttttggagtattttgatatgaatacagatccttatcaggtaagacaatatatgttcattttatgaaggttgttgaaaataggataaccagacataagcttaaatagattgtcctgtctgcattcacagctcacaaatacagtgcacacggtagaacgaggcattttgaatcagctacacgtacaactaatggagctcagaagctgtcaaggatataagcagtgcaacccaagacctaagaatcttgatgttggtaaggaaaaaaatactattttttctattttacctggaaaattctttgtgttactgagctttctgccttggaaacatttaattgcacagaaacatataattcaagatacttagaggagacactttccaggcaattctaaatacaatttgatctctaagtttagctctggtgtactaatgaaaagcttaatccaccaaaagatttggtgagcatttccttccaatatctcccacaggtctattctattagtaaaccttgattcctgatagaagcatctgttggaagatgacacgaaagcgttaggtatttgtttgttattgctgtcaacagtctgaagatatactctgagtaaaccaggatattctctttttttaagagaactttgatggaaagacacaatgctctatttctgctgtcccagtttggagttcccccagttggatccctgcctatgacactgaattagatttcttttgccagtatttttcgtctgaaactagagatattggagcagttcattaacttgggatctaaaaatataagaggatctgaatggaatcagccagatgttccttcccagctatgtgtgttaaactggcttatttctcctttgtttcatggagatgcagttcttttcagtgtccgccccagctcttttctggttaatgaaaatactcatttcctcctcatgatgtctgcagaaatgtaaataccagctgtccatacaaggaaggaggaagaactaaagctggcaagggcatggaccttggcatggcatgccaactccagaagggtgaagagctggactcacaggcacttgggtgcagtttgcaggagctttttgtggtgccgctgggttttctctgtgagtctggtgcagagccagtgtcatcaacagtaaaagtgggcagctttctgggtcacatgccttgaaaggggtagggattcccatcccagaatgatcaatatcaccacctgtcatctcctttccactgcagggtcacaaaggcttttgagttctgggagtcccctaagaaaatataaatcctcagttctcaatcaacacctctcaattaacacttagtggaatcagttgtcagtcaagagcagactgtacttgcaaaataggtcttttggtcactgaccccactcggctcaaatcttttcaaatatcctgcttatctgttgaccttttcctcaaatcttacaaaaaaaagagagagagagagggagggagggagagagagagagaggaaggaagaaaggaaggaagaaggaaggaaggaaggaaagaaagaaagaaaaaaagaaagaaagaaagagaaaagaaagaaagagagagagagagaaagagcctgcaaagacttggaatctcaaccaaccattagaggcactagaaatattatacccagatatttctccccaaaagaacataggacttttattggtggtgacataacaactctacttagtgaaatctgatcgagtcccttaatggtgaaatgacacactgggtggagccagttatgctgtttcacttcaagccgtcctctccaccttccagactattcctatgggagatgattattagcccgtttttttccaatgttttgtctaaaaataaccaaaatttaacttttcctgagaattacatggacttctggaagtacttttcccactgcttttaagtgggctctcctccctttaacacccacccatttttttcatatgaactcttatttttttttttatcttaaaccttttcattcatagctttcaatctgcattttgaacctaataggaaatctctgttgggcttcagcactgtctgtatttaacaccatgtgtttctttctaggatttagatgttgtgcatgaaaaactatatagtgaatggttttataagttctaaagctaacagaaattactcttgtattttcctatatcaggaaataaagatggaggaagctatgacctacacaggtattcacacttttttattcttctcaacagcttcttccccaataattgcatgatccagtggtttcaactaatttctgtttcttaccgtgttgcacagagcaaagctgggggtgcatgcttgttctaacagcattctccactatgttttgtcattgatcacagaactgtcattttgcttttaaatcagctcactgtcccatcaagatgttccagagcatttactcactcccatgcttgtttgcttgttggatgatgcttttaagcatggaatgatgtgaaggaaaaaaaacagaatggcctttgggagccccgggaaagggtgggagatttattttctttgtggtacttacacattgatttggtgggggagcttcatgaaaatgggttggagatttttattaaatatagcatcaaaggcacaaaatgactaatgagaattttaagagcactgtaaggccgaagttgaaggaaacaaggaatttctttgttgatgttcattcattaactttggtggtgaaaagcagcagccgtaagattctgaaagctctgcagagaggtggtgaataacgagaaggtgctgggagttggggacagagtaccgggagtcaagatactagtaaagggccacacacagtggctcacacctgtaatcctagcactatgggagcccaagcgggaggattgcttgagtccaggagtttgagactagcttgggcaacaaagtgagataaaaaaaaatttttaactagccaggtgtggtgatgcacacctgtagtcccagctactcagctactcaagaagctgaggcaggaggatcgcttgagcccaggaggttgaggctgcagtgagctatgatagtgacactgacctccagcctgagggacagagagagaccctgtctctaaaaataaataaataaataaaaaaataaagacactcaatagtgtcaacacagcaccaagacaacacacaaacattccataaacaaccctcagccctgtcattttatgcccctccaaccctcatccatccctcactgtgctctggaggggggacgcacgctcctgatggccgtgtcacttggtcacctggcaatattcgccattgctaattttctactctgagcacagacctcaggcaggtctgccacccgaagcagctgggcactgtccttaccgcctctgctgagacaaaactgaggcacagacgttaccagtaccctagttaatgtatccacttgggagaaaaacatccgtcaaagaaatgtgaacttaattggtgccatctatattaatatcttctttatctatattaatatcttctttatctatattaatatcttcttcatctgtattaatatctttaaaattaacatcccaaagaatgttgctgttcctggtaccctgttcggcccctctaacctccagagctatggtctcagatgcttccttttagagagaaggtcattagtccaccaagaagccaaatgacaacaggaaaggtgatgggaagatgaaaacaaaggaaggtggacttttgggtatatgttatagccatgtatgtatgtcttcttttttctattttctcttgttcttcatcttaactgtcctcaatctgccccacaccaaccctgtgtcactcccagcacacataagacagagcagaagaccccatccttgagctggtctcccctgggtatgggctgaggtaacatcccacacaccaggacgatcttccctgcctcccatcggtcacattaagacattttcaaagtgtaatattataaatggacctacctctaaatattgactttacagttattttatgaggcactcaatttatagctaagggtttttcagtctagtgtcatgaaagagataaaagggtgttcacagattatttaagacataaggctggtcagggatgagtcagagagtcattctccatgaagtcacccctggccaactttgaaaggaagaatgtttaactgcactttgggcgtaaatgacaagcatctgggaccctccccttccctgatccctgccaccaccactcaatcggccagataatcaattgtttctgaggtcactttcacataatcttggcaactttagttgttgaaagcatgcatgcaggggcaacatggtgttacctgttgctttttttttcccccttctaagctccttaccagagagcagatctaaggatactgtgtaacttgaaataaccggcattttcagactttgccatttcatagtccatagggcaagccatctttcagtggatatccacatggtgggcaggaaatcttgacattggtttctcagaaaatatctgcctagtcacacctgggaattcactaaacacccaaatgcagtgtttgatgtggccttacctgctccttgtatcttattggattgaatgagaacagatgcaaaacaagtatgtacagaaatgccaggaaaactactgtcttccaatggggttcaacagttcaaagccctccattgatggagccacttaggaggtttcagtgtcttaattcttttagattttgacagttttagaaaactaaaaaaaaaaaaaacaagtttttatcgtgaaatttgattacaaaagattttgagagaaatgataagaaccagatctgaagaatttgaaatttgaaaattcagcagagcatttttttaaatgtatcttgtacaagatgaactaaataaatgtttttaaactgacttctttttggtggatttcaaaagttaaccttcagacttatttagagggttttcataaagcaagtttttttctgttgctgctcaatttctttcttttcttttctatcttttcttttctcttccttttgctgttccctgtgtgtgaagcaggaggggcagctgaaatgctttgcatactcaccctggtcattttccagttaggacaagctcaaagggagagcacagctcagaaggtggcactcatgactcaggaaataatttgtggctcatttgaaagcagcatcttctaagtgtgttgcaaaatagagaaaaatcaacaggttgttggggtgtttattttccccactgcgtatgaaagctggtgctgctgccctttgatggccaagaggagctcctggcagccgtggccatgtgtcccgggggtgtgtggggcaggcggtcagttcttggcagccttcctctggcagggctgcttcctgatcctttgcttcaagccttctgggctgttagaccacacagagctccaccctcagcagccacgctgtaaccacattgctttcactgattttgactcatctcccccatagtgacagtgtgtgccaaaggtggctgtgggtgacacagccgtgtgttcgtgctgtacggcactgtggtcatgggggtggacgctggagctcctgattagtttgagttcaaatcccagcctcgctggtgggcatgcttagaacagaccctagcaggcgccaagccccagtaagtggtggagtcattggtaaaggataatgctgaatgcaggacatttatatggatgaaagagtatgggaaagggaatttcagtgatatgaattccaaagcgtgttagtatattttataagaaacaaaaaggtattcaccagcaccaccaaactccatcatcagtcacaggcaaccaagaattgatcactctcccagaactttgggaggccgaggcaggcagatcacgaggtcaggagatcgagaccatcctggctaacacggtgaaaccccgtctgtactaaaaatacaaaaaaaaaagaaaaattagccgggcatggtggcgggaggctgaggcaggagaatggcgtgaacccgggaggcggagcttgcagtgagccgagatcacgccactggactcctgcctgagtgacagagggagacgccgtctcaaaaaaaaaaaaaaaaaaaagaattgagcactcaagtccgtcttctaaactgcctgaacctcttgagatgagaagaacaaaacaaacctgcgctgtcctgatgtaggttaccctaatggagcttcctgggttctcctctccctgtcacatctcagggactccaccttattttaaagctgtcttactagcactgttggacttttctgtttcagatgctcaaacaagagatggagcaggggcagggtttggggttaaatgggctggaggtgagattggcccccctaaggtgttgaggacacttggggtgaaagtcgttagggtatatgtaggtcagagccagggccgctgcgtgcacagaggtgtgtcatggagcggccagtaggcaccaaaatccagccaaagctcggccatgagagctgggtagcggcaggggtgacaacagtggccaccctggtaaggttaaggtcagacttgggttagtctaagctgtcagagggtgttcatcatttttcttacctttccaatagtgaccctattccaaaggccttgtttcttgtgccagagaagaaactaaagtatagcacgtgcagaactccttaagatcctccccaggctgcggaatgaaatgtatctttaatcagttccaatatatagggggaaaatgtgccctcattcatccatgcaacatataaagacagaaagaatcgaaacaaccacctctgtgccaaacgccgccttcacagggagtgcagtctggtgttagaatgcacgatgcaaagtgccttgaccagaaatatatggcgtcataagagccaggagagggccccaacccaaccctgagaaatcaaaggaagctttccaaggagttggcatttatgccgcatcctgaaggcaacagtgcagtgatccagacacaggatggaaaaggaagtcagtccaaccagaaggcaagactcgtgtggggacttatcatcagttccgtgacagtgcaagggaaggagaagagaaggatgagctgaaaaggcaaccagggcctattttatggagtgtgttatatggagaatgatgatatgatgtatcttccaaacagggatgttttgaccatgggggaggagtactaaaaatagttaattatttatattaattattatttatattaattctatataaatattgttatgtatttgtttaccaatgaactagtcagtagatctataaaacagttgtatttaaaactattttctaagctaaaatgtcaaaaattctggacaaatgccaaaatgaacagggtaccagtacagcagatacaaactgggaccctcccaggcaaacgaaaaatgtggtcaccctagttacatgctacatcaaaggatgtaatccctgtcctaaaagcaataggcagacattcaagagtattaaactgggagaaataatatgagaggatttgggctgatcagattaggtggcataaatagttatgagaatagttttgtgagtcacattggtttgtgggtcagttctggctccatcacttcccaatttgaggaccagttgctaacagtattacaacacttactgtggtccagcgctcttctgaatgctttcgtatattaatgtatgtaaccctctcgataacttcgtgaggtcagtactattattatcctcatttttttttttttttttaagacggagtctcacactgtcgcctgggctggagggccgtggcaccatcttggctcactgcaacctccatctcccaggttcaagcaattctccttgcctcagcctcccaggtagctgggattacaggtgcctgccaccacacccagcttattatccccattttacagatgaggaaattaagccacagagtgactaaataactttcccaagattacacagctgataaatggtgaaattcaaacccagcgagtctggttctagctgtgctgttcatctctacactatactgattctcttggacaatttatttaacttcttttattatggctgaattttctcatctttaaaaaggtgataatacatacacataataatacacaaggatttcatgagatattacctgaaaagtaagccctgaattcatattattgtatgactgaagtttgataataaatttgattagtgagagacaaattgtatcaaagagccctggaattttttttttttttttttttttttgaggtggagtcttgctctgtcacccaggctggagtgcagtgacacaatcttggctcactgcaacctccacctcccaggttcaagcaattcccctgcctcagcctccctagtagctgggactacaggcacagaccaccatgcctggctaatttttgtatttttagtagagatggggtttcaccatgttcgtcaggctggtctcgaactcctgctcaagtgatcctcccacctcagcctcccaaagtgctgagattacaggtatgagccactgcgcctggctgagccctggaattttgaaggacatttatcttcacattaatggatgacaaaattgcagtttttaatgtcaatgctatattaataaagaggaaaagttatgtgcatttaccaataagtagatataatcagccattaaccacacacaaggtagtcatctataaatgacatatatatttatttctatttttagactatctttagggttgaacattaattggctttcatttgtaaaataaatagctattcctacaattcatccataaaattatgtaggttagaaatttatggtcttctggttgctctgcctgtggagtagccattttttattcctttgctttcttaataaacttcctttcaccttacaaaaaaaataaaaacggctaggcacagtggctcacacctgtaatcgcagcactttgggaggccaaggtgggcagatcacctcgttcgagaccagcctgaccaacatggagaaaccctgtctctactaaaaatacaaaattacccggacgtggtggtgcatgcctgtaatcccagctactcgggaggctgagacaggagaatggcttgaacccaggaggcggaggttgcaatgagccaagatcgcgccattgcactccagcctgggcaacaagagtgatactctgtctcaaaaaagaaagaaatttatggtatttttactatggccaattctgattttggtgtcctgctagtatcaaaaagccaatttacaatttgcttttggatactagcaggacgccaaaatcagaacctctgaaatttcaaagcctaaatcaaattccatttcaagctaaaacatattatgtttcaagtagcatgaaaatcacccaagatgaataccagtttggtccaaatattggaaaccctgtgccttcagaaaaaaaaaaaaaacaaagagctcagcaaaacatggaagggcttaggagaaaggagcagatgtattaacgcagatagtctgttcgggctcttcccattgtgaagtttaaattagtaccattagaaatgagacttggaagagaatagctatattaattaaaatatcctgccagatagcaacaagcaacaaactacatataatgctttatgatttttctgatcgacccattgcttgcttcttgaaactgtagacacctggcccggtgaaattcaatttgctactgagcacaggtacccagaatcaggtatagatgatgccataatggaggggttcacacaacccaggggaacggccagagaggctctgtggaggggatgagagctcctcttgaaggctgagagctgactgggctaatgaggcagggaagtacattctagaaataaatacaaacactgaggaaggagagagcctggtactttcaggacattgcacttgttcctgtggctggtacagaggtgatgtgccaaaggggaagagaagaggccacagaagctgcagaagtcagcctgtgtctgcagaaacaatcccttctgcttcttatgacaccatcagcacctgttaattataacactgctccaggtagagttaaaattccatgcatgcatgatctcttaaattacccgtctgtggaatatagcatgatgtaattctgtggttaagtttttaaaagtaagtaagtgtcatccagaaagaaatgtgacttggcttgcgacctgggtatgttcttgaatttgtcttaatggattcacggcttttctgtttccgggattggggaataattatctgtaatgtgaaatcatctacatttattctgaaaattcacctgtcagaacaagcctatctataccttttctctctgaataaacagcttccaaacgaccaaagaaaaaggtttccttttttgagctgaagacaggcagaaaccaggagacacatggaaaatttaagttctaatgtcgaataaatttaactttctattttgatataactttacatttacagaaaggtcgcaagaataatttcaagaactgttaccccatttgctttattgttttttcttgttctttcactcactttctccacacaccttttttttctgaatcatttgcaagtaatttgcaaacatcattcccctttatatataaatgctttaggaggtatttccgtagaacaaaaacattctcttacataactgttatgcatttatcaaaatcaagcaatttaacattgttacaaagcaattgtcaaatctacatttcatgttcaaatgttaacaattgtcccaataatgccatattcatcattttttgcttttctggcctgggatccaatccagaatcacacattgcaggaaactcacctctttttagagtattcttttatctggaacagttcctcaacttctcattatcagtcatgatattttaaagagtgcatgccagttattttgtaaaatgtccctctgttggggtttgtctgatgtttcatcaggattgaattgaagctgtggatttttgtcaggaataccacatattgtgctctcgggatatcttatcaggagctgcataacatcttggtggtattacctttgattacttggcaaaggtggagtttgctaggtgaagccactataatttttttcttttttaattaataagtaattcatctaccagcttttaaggcattcacgattcatttctgcctgaatcatttgttgttaccatgatggttgcaaatgatggtttctcccactctgtaattcctcctgcttgctttttttttttttttttttttttttttttttttttttgtctgagacacggtcttgctctgtcacccaggctggagtacagtgttgcaatcttggcttactgcaggcttgaccccccaggctcaagggatcctgccacctcagcctcccaagtagctgggattacaggcgcatgccaccacactcagctaatttttaaaaatttattttgtagagacaaggtctcactatattgcccaggctagtctcaaactcctaggctcaagcgattctcccatctctcaacctcccgaattgctgggattacagtcatgaaccatcgtgcctggctcctcctgcatttcttaggtagtattgtactgtaaagaagagatttcccggccagatatggaggctcacacctgtaatcccagcactttggaaggctgaggtgggaggaatacgtgcttgagctcagaagttcaagaccggcctgagcagcatagcaagaccttatctctactaaaaatacaacattcaaaacattagctgggcttagtcccagcacctgttgtcccagttactcagaggcagagcttgcagtgagctgagatagcaccactacattccaacctggatgacagagccagaccctgtttcaaaaatatgaaagaagagattttcctcctctcctgcgtatttatttctatcagtatggacttagattctcagtttattccatggatattctcttgctatcattatttattttgatgattaaagtgtcttagattggccactggtgtccctgcacctggattccgtgtacttttgaagcatcctcatcattttttgaccacctcgttgctttctggcctaaaagcatgttccaggttcatatggcatttttgccactccacatttggaaacagccatttctccaaagggccccagttccttttaaaggggaatggcatttgaacaccaagatctgggtctgaggtgtataaaattgctgctgaggtgtcttggcatatagatccttttgatggatagagctaagagacacactggcatctatcaacatctattcttttttttcttttctttttttttttttttgagacagagttttgctctgtctcccaagctggagtgcagtggcatgatcttggctcactgtaacctccactttctgggttcaagccattcttcttcctcccctcccgagtagctgggattgcaggcacctgccaccatgcccagctaatttttgtatttttagtagagacagggtttcaccatgttggccaggctggtcttgaactcctgacctcaggtgatccgcccacctcagccttccagagtgctaggattacaggcatgagccaccgcgcccagcctcgacatctattgttgtacctacagatatgtagagatatgtctaattgagtgacctaatgcttccaatataatgttaccctgctcctgatttcaattaaaatgcttttagagtttctctattaaataagaggcaagctttaggactgagttatatatacttttatcatgttaaggaaatagccatcagttcttttttttagtgcttttatctttaatgaacgttgaatttgtcaaaaagctttttttagcatctatgaagatgctcagataattattctctttagatctattaaattattattgtgtattatattaatagatttggtaagaatgaatcctttcattcctgaaataaattccactgggtcattgtgtgttgctttcgtaatattgaattctgttcactaatattttatttaagatttttgtatcatatttttaaatgataccaatctgtgatttcctttttgtttttaccagcattatctcttagatatattagtttcttattactgctgtaataaattaccactgtgcctttaaaacaacacaaatttattctcttgtgtttctaggggtcagaaattcgaaatgaatcttactgggctgaaatcttctgggggctcgaggcaagaatgtccttgcttttccagtttctagaggctgcctgcattcctcattcatggtctcttctgccatcttcaaatacaaaaatgtagccaatcttcaaatcagtctctcccccaacccccaccttcctctgttttctggggtcacatctcgttctctacccctccttcctaccacctccctttccctttataaggactcttgagatcccactggccccacctggatgctccaggatactcccccaccccaatctcaggatccatgacttagtcacatttgcagagtccctttggccaggtaaaggaacttgtccatagtttccaggaatttggatgtggacatctttgccgggtggagtccactattctgcctatcacagctatcaatgttatccttgcttcgtgaaaagagtttggaagttttcttgagttatctgctctagaacagtctattagtattctcttttcattgaagatttgttaaacttctcctgtgaaagtccacagacctgatgcatctttgcacagtggttctttgggcttgctttttcttctatggaaactgttctatttaagctttctatctatattgggttgttaaatcaagtttagcctaaatctgcctcctcacatattttaagttcagcctaaaggtttctctgtatatcgtgaactataacctaaatagagttgtatacagactgtagcctactcttgtgcccatcactgagttttggcccttcaaaggtggccaactgctcaaactctgttcaaataaggcaaacactgagctgtaaccaatctggctgcttctgtacttcacttttgttttctgtccgtcgcttttctttttctgtccatacatcttcttccaccacgcagctgcgttggagtctctcagtctactctggcttgggaggctgccagatttgcaaatcgttctttgctcaattaaactctgttaaacttaattcagctgaggtttttcttttaacagcatcaatttcggcaaactattttcctgagcaactacgtttcatccaggttttcaaatttgttctcactgaggtctgcaaagtagtctcttgtttttattttttttttaagatggggtttccgtctgtcacccaggctggagtatagtagcaatcatggctcactgcagcctcagcctcctgggttccagtgatcctcccacctcagccttctgagtagctgggattacaggcgtgtgccaccacactcagctaatttttaaatttttattagaggtgagttcttgctatggtgcccaggctactgttaaactcctgggctcacgcaatcctcccatctcagcctcccagagtgctgggattacaggcatgagccacatctcttgtgtttttaattttgtgtatttcaacgatttttaaaatatttaccagtttattataaaggatattataagaaatgcaaataaatagccagacaaagaggtacataggctaaggtccagatgggtcccaaacgcagaagcttctgtccttgagttcgaagtgtgctaccttcacggcatgtggttgcattcaccagctggaaatttctctgaaccctgttatcgtttaagatttttaatgaggttccattacataagcatgattgattgcatcattggccattggtagttaactcaatctccaggcccctgtccactccacagaggtctgagagtcccaactctctaatcatgtggaggtctttctgatgatcagcccagctcccaacctagagctgtctagggtaccctagccatctcctcagcatataaaagacactcttatctccctggagattgcaagggcgttaggatctctgtgaactgggggtagaccaaatacatttttcttattatgccctagtcccctggccatgaaccccgtagtgagaagattataaaagtcaaaagatattggcacattcctagaattgcattcagccatcaataattagtccagtccatcattctgtcatatgaaaatacctcctagggcaaggccactcaggtttgccagcttctgttggatcttgccaggagtggcttagcaatatatgacctcacccttttaggagtctggtataatggagctaagagacaatgtcatctcctgttctgagcctttttcaagctgttaatgtaatattggatttctctcatgactcatgacgtaacccacttattcattccttcagcctcagttactattcctccatctctccatttatgaccaaagttttccaccttcggaagagacattagattcagccactgtgctgctctaggcttcaggcagcaatactagtctagtattatcactagactaccaataataggctagcaagtacctcttgctcagtctgctcccattcaaatagagtaagtttatataggtgcagaactaatgaactgtttttaaccaccaggcagtatacctgcattcactgttaaccccagttttgccagatggggtgaaggcacaacctgccctatcaggcccttaggaattctgacatcgttttaaagtataattagggttttttgcttaggaaacatccctgcttccaacaccagcagttgcatctctgcatcacgtataaaaaagaaagttgaagtgctgtgcagaagacttgcatcatcacaccggcatcctctcctgccccctctcctcttatcctcctgcaaagcagagaaatctgtccagtgggggacactcccttagcccccttatgttgagtgtgaaggtatgtaagccagccttcaatgcttttgtctccccacattttagacagcaaatgttttaactgcccattccttcctgttcttatggaactgttactctaaggataatgtgcaccattatacgtccatttgatgtgagctatctttgctcacttttggacattatgggctataaaatgtgtcctttcatctgaagaaatgtaacttggtggtccaaattagtacagtattttccgttcctatcctgtaataatattttaagcatttgcattgcatttaagtagatgcaatgcttaaaatgggtctacaaaacccagcctggggtaagtgtctatttctgttaagaccctgatctatcccgtcggggctactggcattggttgctcccatgtaatccacttaccagctatgcatggggtgcctaccccaggggaatctgccccatagccatctgcagtctctgactctctttttggcattatatgtctgacagtgcaagaggaataggtccagacttagcccatctctgcatggctgcagcaccaccccccatacccactcattttatgagccccagtggctaccacaagggagcacaccaaaaggtccacttgatggtgcccgtaatactccaatacatattcttatttactcttgctcccttgtactgataacacctattgtgtttctatatatttctcattgcatcttctataatttcttctttatcaagatagttgctcttttggtaattgtctttgtacttacacatttttattgcccttaatccctgttttgtgttttttcttttttggtatttttaatagagacagggtttcaccatgctggtcaggctggtcttaaactcctgacctcaagtgattcacccgcctcatcctccccaaactactgggattagaggcatgaggcaccatgcccggtctaaatccctgttatcttatttaacctttcattatctcattagacagtttttaatggcttctctcactcccagctattacctgaatcatactgaatgagattattctctttggtctgtgctccctctcacatttttagttgcattatttctagcgtgtcctataaaatgcatatattattttttcacacttcttctacctttatttttatcctagatctgataaatctattaaatgtgcaccctctatatttttgcttccatttccccattgatttcttggacaaacgagtcacagcctctggaagattgctgaagaagagctgatgcgcacagtatcccctgcattcttgtgtgtttcaaactgttcctttatagccttgatacttgaaggagatctggactggatatgagatgctaggttcatatttgaatttctgatttcagatggcttttccatcctcatatgcttgattgagaacatttaattcacacagcactggtgtgttgtggttttctgcactttatagtttatttcgccaggagcattttcttaagatggttttttaaattcttgttttccactttatttttgttgttgtcgttgttgtttattttatttttttaagttctgggatacatgtgcaggatgcgcaggtttgttacataggtaaatgtgtgctatggtggtttgctgcacctatcaacccatcacctaggtattaagcccagcatgcattagctattttccctgatgctctctttctcccaacaaccccacaacaagccccagtgttagatagttccccttcctgtgtccatgtgttctcaatgttcggctcccacttgtaagtgagaacatgcagtgtttggttttctgttcttgtgttagtttgctgaagataatggcttccagcttcatccatgtccctgaataggaaatgatctcattcctttttatggctgcatagtattccacggtatatatgtaccacattttctttatccagtctatcattgatgggcatttggtttgattccatgtctttgctattgtgaatagtgctgcagtgaacatacacgtgcatatgtctttataatagaatgatttatattcctttgagtacatatccagtaatgggattgctgggtcaaatggtatttctggttctaaatctttgaggaatcaccacactgtcttccacaatggttgaactaatttatactcccaccagcagtgtgaaagcgttcctacttctctgcaaccttgccagcatctgttgtttcttgacattttaataatcaccattctgactggcatgagatggtatctcattgttctactttcttttatggtaatttgatatagatttaggttcttttatttcatggatttatactatttacaaccctcctggtttaagagaattcttttctgtgagtgtaactaagtatacttcctctttacctttttattttattattatttgggagtgaaagtgagagaggttgtgtgtcttccaacttttcgtatctcttttttcttgcaggatctgaaatttcccatcttttgcttcctctttgttttaccacccagtttccaatggctgtttctcccttctctcttcctttgtgtccttttctgccctaagcaatgcctcccagactgctgccttcaatcgtgcacaggcacaaggctgggacttaggggtcccatcctcattgtcagtgctgtggctcaccaggaatctttacagtattttatgcaaaagattgacgttctttccaccaacagcctccaatcaatctttgactccactgacacttccctcttctctcttccatactgttttcccagagcttgtggccacagtgtgacattcagctctgctgggatttggtgtcaacgttttttatctacacgtgatctgaagattgtaggattctctatcttctagctagaccgaggttgtgggtttggtatagttttgcttattcttcttgctggtctgtatggctttatgggtggtcattgcactcatctaggccacctctttccaaatggtacttaggcacaactagagaacaagtgttattttctgcagggctacagtcatcctggagatgtagaaagatctgagagagagaaagctggtgccttctttgcatatgagaaagtcattcagttatctaaggcacacatttatctaggacatagaactttcagggcaaaaacaacaatcaaagaaataaatccaggcatttgatttgaagagcttaattgcattcagatttgcttttatactgagtgttagggaatataaaataaaaatatcatactaagcattgcctattacattcaaatactttcaaatttgtcattcacccagcaaccttataagtagtaatgattttatcatacaactatttctacacttgacagatgagggagcaagactcagagggactcactcacatgctcttctggttgcaaagttgatttgagtggggccaggagtgaaacccaaatcccctggctgaaaggaccgtgccattttcagcactaaccatgcttagtcatagatgttttcacgaatgtgatcttttttttccccaattttctgttgtttaatcacctgtaacctaaggccactctgtgataacaaatgactaggggaaaatgcttttgagtgtcatacttctcattgattaactctgtaaaaacaatgtaagttgcttgtccaggtaagtagaaagccttttctccactaatgattcaccttcttctctcttttcacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctgtttcagagaaatgaacttaaccaagtttttgtggtacacccatttcttgcaagtaaaattgagtcatgatctctatttacatgattgaatactaaccaaacttataaaatggagctgaagtcaatgtgttatagaacgttctcagattaacaacttcaccacggatttacctcattgctgtcttgagggaggcagcagaggcagcgccaaggtagctttcccggcaggcaacctagatggtcacaaagggccagcacttggtttaatgctctgatgtcaccgccttgaaatccttaataattttttaacaaggggccccacattttcattttccacgggggccctgcaaatcaggtctgggcagaaccaaaaatggttctgggcagtaaaatggaatttttcaaaaccaagagaacagacccactgaaggcagtgtcggttcttcaggaaccaggaacttgggtggaaacctaaacacccttcaagatctcaagttttttgatacacaaattccatatgcttccttctgtctgttccaaatctcctgaagaaatttagccttcaggttgaggggctaaaaatctgtgaaatgtccagagaccagaaggttaaaaataaataagaagaagaaaaaaagaaagcaaagggtcaggggacctaccaatccaacccttggataattgaggaaaccaagttttcaagagaacatagtctaagataatagcattgttgtccaaaggcgcatcttggtgccttgctccttgttcctttctgtaaaatgtgcctgagtcaaatattgccatcctggagaaaaatgcatcttagttccattcaatagctgcatatggagtacctactatgtggcaaggacatgagagggattgcatgtctcccagagctgtttatcggatcttgaaaggcccttagagattggctgcccagctagcctcatttgatctgcgaggaagctgaggctcagaagagctgagcgacttccctagacgtaaaagaggaagagatctctcagaggccaggcctctctactttctccatttaaattcatatgcacatacacaagtgtgtggggggcacgcaagcacgcacccccccacacacattcacacttaccagaacggggaagagagggcatcgggggccacatctgcaaggactagtggaaagaactatgaacatgaaactcaacaagacccaagttaacttcagacactattttttactatttctgtgagtttggaaaagtcacacaaacctctctaaaacagcttcctcaactgtaaaataagagatttgggtcaaggatggcaaatacatagcatatgtgacttcttttcccaaaatatccccagggaagacgttgctaatccaatgggacgcttgtccattaagctagagcatttgtggccttacaggccttctcaacacagccaactacttctccagccagctctgctgttgaataagcattggtgtgcgagacaaaaaccaactgtccctacccaaatgagattatttctgagaccctcctggccttttaaaaataaccaaacaaacatatgatcgtcagcatgtgcagttttggtacagagagaaggaatgaatatactccatccctttgccaaatatatctcaaaatgttggcttttttttaaaaaaagtgttttaaatacttgtttttcagagctcgtttaaaaccctccattccccaaattagtccaattctgcctgatatttctgaaatgtatttaacagaaaacaaagaccttcagttgataattaaattaggtattcattaagcaattaatacctgactatgccctaacacccggggcttttaggcccccaggattcatagaaggggctgtgaaagctgcgatagtccccaagcccctttcccacctcctccctttcccacctcccagcacatcccacactcactgcctggggagtcttccaccaccttggctcagatctcagtctcctgctcagaggccttcagtgcttcctgatgccctccgtgttctggactctaagccacaagaagccccagcctcccacccagctcctgctcccgccctgcctcacctgtctctcagctgctcctgggttagcgccgccttcccaggccggaactttcacttctctttcccctcctgtttataatatctacccccagccccacctcaacctggagaaatcttgtccatcctttaattcccatatcagttcaaaatttaccttttccttttgtgttcactttcctggactcatcgacccctgaaactactatctcccctatttgacactctcctcccggtaagcaaatgctgatgttgtaccaagtctgcggccaatggaagaaaaatcactggccacacgtatcacctcacccttccccactgctgaccaagaaactgaccctcatgtgaccatcattggttgtggtctagttaactcacctttctctcagtggtgttgttgacactgagcacgttgccagcacagtaccttgggccttgtagtgacccctctgctgtttgaagtaagtagagagaatgacttttaaaaatcaaattttctctgttgagaccacagaatccctgagccctcacgttgggggaagcactacagaaagataggggacaaaggaatccgcactaccttactcttcagctggcgaaggtattgctttctgtctgaatttcctggtcctcgtatcagtgggcctccttctggcactcaggtccagaatctgcatccaccaccgggctccccattccttccctgacgtttcccctttccagccccaacagggcgtatgactcagagctagagcggaaccaacccaacctctagtaagtttcagcaggagaggggtcatggaccgaccctgccaccctaatctgttttcgcatcactaagagcatcaccccatcaagcccaagaaccagaaaacacgagattagcatgtgttttccaaaatgaccactaggtggtagtctagttcaactaaagacatctttgcttggctccaggacccacccctgcaaagcagctactttgatttctaaagtagcagcgcacctctcggtgttaccattttgacaagaatacagctagaacagcttgatccttggcagacttgccctttcttcagtgcttaggatcttagccattccagcaggcgaaagaacagtttttgcttctgatttatattggtattttaaattggaactgcatcaaactttgacgtttcaattcaaaagtgagcactgaatatcgatctccctgctttccaaagtctttgtgcaattaaaaatgttttttagctcccatacactgaaccaacagaggtcatctctgcctagctggcaattttgcaaagaagagcggaactagatgctttttaacagctcttaaaacactgaggttgtaccaagtctggtgctaaagcaaggacgacaagtgaccatattcataacctttccccctcctcatttcttaaaaagaaacattttctaatgtgcctattcaaaaagcccaatacccaaggacgtcatgtctaaaacaccaaaaacaatggccacaaaagccaaaattgacaaatgggatctaattgaactaaagagcttctgcacagcaaaagaaactaccatcagagtgaacagacaacctacagaatgggagaaaatttttgcaatctactcatctgacaaagggctaatatccagaatctataatgaactcaaacaaatttacaagaaaaaaacaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgacataccatctcacaccagttagaatggcaatcattaaaaagtcaggaaacaacaggtgctggagaggatgtggagaaataggaacacttttacactgttggtgggactgtaaactagttcaaccatggtggaagacagtgtggcgattcctcagggatctagaactagaaataccatttgactcagccatctcattactgggtatatacccaaaggattataaatcatgctgttataaagacacatgcacacgtatgtttattgcggcactattcacaatagcaaagacttggaaccaacccaaatgtccggcaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacaccgcatgttctcactcataggtgggaattgaacaatgagaacacatggacacaggaaggggaacatcagacaccggggcctgttgtggggtggggggaggggggagggatagcattaggagatatacctaatgttaaatgatgaattaatgggtgcagcacaccaacatggcacatgtatgcatatgtaactaacctgcacattgtgcacatgtaccctaaaacttaaagtataataaaaaataaataaataaataaataaaaataaaatgttaagagagagagaaaaaaataaataaataaaaataaaaagcccaataccgaacacagatctacctatatgctgaaagtgtgggaaatttaagaaatttaacagagatccttttgcctaactcatgcacacataattgagcagaagatggtagattcaggcagggattactacttgctctttgcataaacggctgccttgatgaatgtagaaagcgatggggggaagtcaacactgacacctatactcccctcccccaataactcatgtagcttaggccactgcgaccctttaggtgagcagtgggatgagggaatgaaaagtggaaatcagttatgctgcttcccacctacagagtgctcaaggcaggattctaaatatactcacgttgtgcttcagtccgtgagttatgactcccttacctccttccacctctcactccaaagttttagatgccagtgtgtttagaaaactctgccactagtcaggagagacctctagatccagggttttttttctccctaagtggatctgtgctcaagttcttcttctttctaacttaacttttaagttcaggagtacgtgtgcaagtttcttactcttgtctcagagcactggcttctgggccactttaacaatgaatgattagtttgctattcagtagcatactaggagacaggaggaagggagattttcagtgctttgttgaccaagttttgatattcatgcctttagaaattattccagtttttggaataatgagttggacttctttggaaattattcttaacctatcaaagtcaaccatgtggcaaagaattatacccactgaattcttaccatttactcctctatattttcaggacctcaggctcttaggcagagccatgagactacttagggccaatgaaatgggagaatagacacatggcacttccaggctgagaaagagaaaagctcttttgccattctcagggcatttcctttctttgccccagcaaccaatattaacgatgaaagttccaggtggtgccacttcaagatggtggagcctctgtcagcctggatccctgaaagactatgtggaacagagccataatagatatgtaagtgaatgagaaacagacctgtgtgttatgaagccattgagatttcagggttaatatgttatttaagtataacttaacaaatcacattcaaggtacatagctctgtgttctgaaagtctgttttgaatttcaataagtaagtgatgaattacttaaaattattctctttggagactcaataaaaaaaaacatgctatggctctttaaactatactcctaaaactttacacatagaacattctgcttcaatgtagagttaacagttaggtaaggagttaatgatgtaggaggggtggacaatcgcattggtctcattgcttcatcccttcaaacaacaaagttctagaaacaatttcatttcagtccaacacactttattcatttttaacttttttcttaattttcaataatcaagtattcaagatgctgtaaaccaagattagtacatcgacaacagatttcattaaacacacggaaattatacatcttttaaattaccttaaaaagtctccaaatgaatatcattttaaaaatcacaaaatcaaacttctttatgcaacagtgcaaaacctttcatcacaaacatacctctacacaaaacacacacacacacacacaaacacacactccactaagaacctaatgccagtttagttgacacagtattacatttccttaaacaaaagagtcagagcctgacttgcctgtttcaggattctaaattaacatttggggtttggggtagaggtatgtattttaagaaaaatgcccattatttggtactactcttaccaattatcaattaccaattgccaataatcggtactagtcttaccaatgattcttatttttcatttctagatacaaactttaaacctcttttgttcacccctttggtttaatgtgtccctgcaattactttagtttcaataatattttctccttcaattttaacatgtagtgataggataccagaaaagataacaccttcaaaaccccagtgttaaaaataccttacatgggtgtaatctttttggagaagaaataagaaaaggttacctgaaatattttttctacctttctctgaaattatttttggcatctgattattcttgctaaaataaatatcaaaagcactgagtattccatagaaaagtatcccccctttcacgcttcatttttgcagcatagatggagtaactgttgaaatgagagtaatggatgcttgttttctggaaaattcttcagatttccaaacacaaagtacatgcagccacttagcagtgaaatactgtgaattcagtggcgctttttagtggtgaacatgcgtcattaaatactttttagcaccaaggcattttttttaatgttgcaaaagcaaacacctagggagggttttttgttttctgttttttgttgttgttgttgtatttgacccttcctagagctgagtaaaactgaagtctttaaaataaaacctcctcaaacatacacagatctgattctaatgcaacaagaagtttgggacagatacagccagcagcatcccaaaagatgaagaagagaaaaagacaaaaagataaagtgcatgaggcaactacctttgcctgccagccgcagcactctcttattatggaagagaaaacacaaatgtgtggaaaggctacctactggtctgtataacagagaactagcaaacctgcagtttaggcaattctgggattatacagtattttggtatctatctgctacttagaatactcagtatgcacctacatatcaatagttatattcatgtgctgtgtcatctctgatgttttaagtacatacacgatcacaaaatataattggctaccacccgaggcttgggcttgcctcctgctcctgggtgcactagggaattcccatcaatgcttcagctccatccaaactctaaagtttctctttggtacatgcacggtttctacaaaacagggccaaaaagacactttctggctccaagtgcaccaaagagcgcaagctggaattgtggactgaagaagaattttcttggtggttggtgaacatggaggaccaccatgacatccatgaggccttactccatgtaactcccccttctctgaaggctgacatttccaagtgcatgccactaaaggtaacaatgtcacagcgactaaagggaacaatcgggatcagtggtttgatatgtattttatgtgtgttcacttaaaacccttattaggaatcttaaaactcatattcatcaaaaaactaatagagatgttaatattctgaaagaggaaaataaaaaaaaatacacttgaaatccctaaagctcagattcaacaaatctgaactacctttcttcataatgtttcatttcagaaactctgccgagacccgatgttaacacgaagactagatttgttctgtattaaatatgaactataaataaatatttgaggtatgttatgacaaataactttaatataacacttagctaaataaatgtaaatttaccttgaaaatctagttaaacattaaatcttgatatttcctacagatgtttcctacagttttttttatttacacaaaaaaacctctctactcttcataaacggtaatatatcaaaaaattgaaatgctttaatctcacgattttatagtcaccttgcctttgttaaccaaaagctattgtatacattgcgtagtgtaaaaaatgaataatggagtgagagaaatctatgtctgaatcctgactttaccattctgtatgatcctaaatgagttattttacttctctgagtcttggtttcatatgttttttaaaaaaataataaaatcagccgggcatggtggctcatgcctgtaatcccagcactttgagaggccaaggcaggtggatcacttgaggtcaggagttcaagaccagcctggccaacatggtgaaaccctctctctactaaaaatagaaaaaaaatagctgggtgtggtggcacacaccttaatcccagttcctcaggagactgaaacaggagaatcacttgaacccaggaagcggaggttgcagtgagctgagattaagccactgcactccagcctgggtgacagagcaagactctgtctcaaaaaaaaaaaaagaatcaaatctttgcaaggtaattaagaggatcaaaatgaatgatgatgtatattaagtgcttgtcaaaatgctctacaaatcgtcaacactcaacaaatgctaatttttttcctctctgttcctcctttctctccatccccaacaccttgactctgaattacttttgaatattttcaagaattaaatccacctataaagaataaggacttaatgctaatgaaaataaccaaagaatgcgctccaaccacccatcttacctcctgggagtttctaaattaataggatgaactcaaggatattgtatttgcatattaaagctaaataatatatgaatttacagtttataaaggacaagatgaccttttccaaaacaagtaatttgaagcctaagctcatggagagtcttcattaaaacttctaataggagctgtgactataaagtaatgggatcaatttattaagaaacatataagaccctatatatacaattaaatggtatcatctacaaaacagtcacttcagttggctatgtaatattccagtgatgctaccatagccccaagtattttgtgaaccactcttaattggtacatattccaaagctttattttctcatgatttttactacttagtctacattcaccaacaacacattaatgaaatacctgctatttataaggagcagatacttgaggaagtacaatattaacactgtggtgcacatttcaggcccatttctttgagttctggcccaatcatcccaaaggattttatggagtggcagatggtaatcaggtaatatgacacctgaagatacctggcacctgatcagtgatcgccaaactggatgactgttcatggcagcaaagggagtaagggggctctctaactactccgtgctgagtccagcaatcttagctaccagaaaaagtgccaatcccaccaaaattctctcaatgcagtatcttaatgatcagaagaaaattaagaaaacaccacacctctccaatctacatatctttaactcccacaccaaaggaaaatttctcctttaaaggatcagagctctcccatagagggta

SEQ ID NO: 361 - DNA, 237093 bp, Homo sapiens
gtgactttgggcaggtgaattagacttcagagtttcaatgtttccttctataaagtccagatgctaattacaataactatttcaaatgcttatggaaatgattaaattaaaaacacataaagcacagcacacagtatgtgatgcagagcaactgcttaataaatgtctgctgtaaatggatgcataggccagtctggaaagaccacatggggctctaatgtgcgttggtcagaccctgcccatcctcagaagtagaaaacaaaatgaaggcatagatctgactgcagagttggtgaaggcataaggccagtgctgcccttattggctatttgggactattcagcttcatgatgtgagctctgtgcttttccctggacccatctggggtggttaagagcagggctcaggagtcatactgcccatctctccagctgatcagctgtgtgaatttgggcaggatacctagtttctgtgcttacatttcttcagtagaaaagtggtgataattaagaacaccaccctctgcatagggttgttatagagattatatgagctaatatatttagggcatttttgttgtgtctggcacatagcatgagttcaaaaaacagtaaaaataattttaatataacactgataattttaactttgaaatagacctctaggattctaaattccactttgtttcccaataagagctttgcagaatgaatttatggagagaatgagaaagaataaagttaggagtaggtagattagaggtgggaaaaaaaggtcaagaaaatttgtaatggagataattgaaagtataaccaggctgggtgaggtggcttacacctgtaatcccagcactttggaggctaaggcgtgagaatcacctgaggtcaggagttcaagagcaccctgaccaacatggtgaaaccctgtctctgctaataatacaaaaattagctaggcatgatggtgggtgcctgtaatcccagctcctcggcaggctgaggcgggagaattgcttgaacccgggaggcggaggttgcagtgagctgagattgtaccattgcactccaacctgggtgatgagagtgaaattctgtctcaataaataaataaataaataaatataaagtattaccaatatgaacaggataacatttctgaaagaacatttctgaaaagtagagaacataaaatatatatagagaaaaaatatttgtgtgacaagacagcaataattttgcagttacaattaatgaatgaatgatataagcagagaaggaaagcttaaatatggaaattaagaaccaacatgaaagttgtatcaaatatctttgcatttattgttcactaaataaacttttaattaattgattggtttttgattaatgtgattaagcactaaactcggcagataacctgaagcctggttctttgcacagagtagggctgagacaaacgtatggtttttctatggtctctgaataaggccagaggcaatatagtggatctctccctctttctcccccttctgcctcctcctccccttcttacttccttcctctctttctgtgtacacagagatttttgtcaaagctttgttactaagtaaaggatcaagaaagggattactaaaactcttctttaagtgctcactacccatattctcacccataaaagtgcacatttacttccttttttcctaagcaggcagctgagtgtcagtcgacctgctccagattcattttcatcactggggatgggggaggtttgctgtgggcaatgaggaaaggggttggttcattggaattcttttttctggcatctttttggctagttggatagtctacaaccacttgtgacactctctaaccaattttggatttcatcatcctcttctctctttggagcatccagagtgactgcagcagttgcccagacctgcccaggatgagagtcgtcagccactttgaaagacagctctagggatgcagaaagcatttttttttttttaaattcatctgttggtggagggtactgaggtccaggtttttctcagtctcagttaagcagaaatctgacctctgctctcccttctggccttgttctgaaacgatgaacaaatgtaaaaccacgagaatctactaagagacggcagaggagtgccaggccctccgacctggaacatggccctctgttcctttcagtatatttcgtatatggtgtatctttttaaattctaaagccaacaaatctctattttctttaaagtgaaagaaatggacttacaactttataattgtccatcataaaactggaaagaaatccacacagtccaggagagaggaatacagattttgaacataccagaacaactgctactggaataatggtgcaacgataacacacacatgggcaaaatagagctgctcaattccaaatttgcttttatttcatctctcaagaaaattcactcgaaacaggaaagaataaagctcacagattaaaggctattgatgcccaagatgacagtgatagtcacagaacatgaactctaagtcagtgctagtctcttggtccagataaattatgtatacttcagggtctaaagcaaatgttagaatgaataccttttttggataattaggaagtttttgagcatttgatgggagtgctaatcactaggaggtagcatgggttcactgagaaccagtcatgctaatcaaatcttattttcttttgttaaaggcaactatctggcaagtaactgaataaaacaaaatgacaattaatagaaagttttgctgttaagaatcccacaccatttcccaaagtacggaatctagctcacaggaacaggggtaaggatgtggtctaagagcagcatgaaagatttatgggatttcatccatggcatgttgagatgctgtaacccaagcagcaactcagaagcctgaggcacagagagagcaggaagttgatgctaaagggtgaaggagtgctgggctcagctcaggaactctatttcagaaaggattttgaccaattgcagcacacgtagaagacagataagatgatgagagaacctgagcaatgtcacacaaaaagtggataaagataccggatatttgtgttctggacgtgacttggagcagcagtgtggcatggaaaacacaggctctggagccagacaaatttgaatttgaatgctggctgtctccaataagctggagaagttccatggagaagttactaaacttctctgttcttgtttcctcatctgtaaatgtaaaatggaaacataatgtgtgccttgctgggtggccaggattaaatgcaacaacatatatcaagtgcatgatggtatataacaaatgcttaataatgattagttataatcattaatgtatatcattcagggacattgtaggtgacttcaaagatctttttccaaaggcctttttcttttcttttctctcttttttttttgtttttgtttttgttttttgagtcagggttctattccgtcacccaccaaaggcttttttcgtcagcatataaactggaggttctcaaatttcattgttcagaagcattacccagtgtcttattctgtttgtactgctgtaacaggatacctgagattaggtaatttaaaaagaaaaaacatttattgtcttataattctggagtctgggaagtctaagatcaaggcactggcatctggcaagggccttcttactgtatcatcacatcgtagatggtggaagggcaaagagacaaaagggggccaaactcacccttttataacagcataattctacccatgcaagtggagccctcatggcctaatcatctcatcaacattctaccttttaatactgttaaaatggcaattaaatttcaacatgtatttttgtccaaccatagcatctgggatgctctttacgaaataattgtgtaggtctgagtgaatccgaggaaccagcattttcataagaaatccaggcaatttcagaaaagaaggcaagtgaaccttactttgggaaacattgataaaaacattctgaagtcgctcctatcttcaaacagcttttcttctatgcacttttttttttcagttaccatcttctctttgtccttctctcaaaagatttacttttacttctacttggtaggtctaaacagcaaaacttcctaaccagggcaccagggaagcttgatgtgccacagaatgggtaatacctgggctgagactttgattccttctgccacagtccctgctggccaccagtggcctagtcccttacccccatgtgctgtaaaaagttcactttctatctatgccacgacaagtacaagactgagaagcactgccttagagagcaaggatcattgtttatttctctatatattacccaggacctggaaggcttcctgagtcacaggggacttcctctgtcatgctttctgaatcatagaagaatacatatttgttcaatgaatgaaagaacaaatagttggggaaaggtaacatatttcagctaactctacttcttcaatttccatgtactttttaatcctgtgttcagctggttccaccctcaccactctactataattgcagaagaacagaggctttggagccacaaagatgtggattccagtcctgtttctatcatttaccagttttttgcctatttcagatgtctactgctgcattaaaaggttgctcccaaactctatgacttaaaacaaccaccattttattgctcatgattttgtgggtgagaaatttggtaaatggggatggttcacctctgcttcacttattgtctgctgtgctcatttgtgggctggaaggtccaagttcgagaggtccatggcctcactcacatgtgtgaggtcttgggctggctgttgactgaggcatctattttagtcttccagggctactgtaacaaaatagcatatactgggtggcttaaacaatagaaatttattttctcacagtcagaagtctgggaagtccaagctcaaggttgcagccaattccatttctagtgagggctttcttcctggcttgcagagagctgccttctcactgtgtcctcacatggcagagagaaagcaaactctttgatgactctttttaaaaattattttttatttctataggttattggggaacaggtggtgtttggttacatgattaaattctttagagatgatttgtgagatattggtgcatccatcacccaagcactatacgctgcaccctatttgaagtcttttatctcctgcccccttcccaccctttcccctgagtccccaaagtccattgtgtcattcttatgtctttgcatcctcacagcttagctctgcttgtgagtgagaacataagatgtttggttttccattcctgagttactccacttagaataatagcctccagtctcatccaggtcactatgaatgccgttaattcattcctttttatggctgagtagtattccatcatatatatatacatatatatatacacacacatatatatacacatatatacatatatacacacatatatacatatatatacacgtatacatgtatatacacatatatacacatatacatatatatgtgtatatatacgtatatatacatatatacgtgtatatatacgtgtatatatacgtgatatatatatatacatatgtatatatacgtatatatgtgtgtatatatatatatatatcacagtttctttatccactcattgattgatggacatttgggtcggttctgtgtttttgcaattgtgaattgtgctgctatatacatacatgtgcaagtatctttttcgtataatgacctcttttgctctgggtagatacccagtagtgggacagctgcatcaaatggtagttctacttttagttctttaaggcatctccacactgttttccatagtggttgtaccagtttacattcccatcagcaatgtagaattgttccttgttcactgcatccacaccaacatctactgttttttgattttttgattatggtcattcttgcaggagtaaggtggtatcgcattgtgcttttgatttcaatttccctgttcattagtatgttgaccattttttcatgtttgttggccatttgtatatcttcttttgagaattgtctatccatgtccttatcccactttttgatgggattgtttgtttttttcgtgttgatttgtttgagttcgttgtagattctggatattagtcctttgtcagatgtatagattgtgaagatttttctcccactctgtgagttgtctgtttactctgctgttttttttttcctgtgcaaaagctctttagtttaattaagtcccagaaatgtatctatctttgtttttattgcatttgtttttgggttcttggtcacgaaatccttgcctaagccaatgtctagaagagtttttacaatgttatcttccagaatttttatagtttcagctcttagatttaagtccttaatccatcttgagttgatttttgtataaggtgagagatgaggatccagtttcattctcctacatgtggctagccaattattgcagcaccatttgttgaaaagggtgtcctttccaaataaaatacttaggaatatacctaaacaaggaggtgaaagacctctacaaggaagactgcaaaacactgctgaaagagatcagagatgacacaaacaaatggaaacatgtcccatgctcacagatggatagaattaatattgtgaaaatgactatactgccaaaagcaatctacaaattcaacacaattcccatcaaaataccaccatcattcttcataaaattacaaaaaacaattctaaaattcatatggaaccaaaaaagagcccacatagccaaagcaagactaagcaaaaagagcaaatctggaggcatcacattacctgatttcaaactatactataagaccatagtcaccaaaacagcatggtagttgtataaaaataggtatacagaccaatggaacagaatagagaacccagaaataaacccaaatacttacagccagctggtttgatgattcttataaggaaactaatcctattggatcagggctctacctttatgacctcatttactcttaattaagtcctatctccaaatacagtgacatcgggaattagggcttcaacataagaatttacagttcactctatagcagtatctcacttcccttctgtatgatattctttctccacattgtttctcattcttctggacccctctccagcaagatatcctgtaaaagttgcaagatcttttcaagtctagactcagctcagaatttcacttctacacattctgttgaataaagtgagtcacaaggcaggcccaaattcaagcagaggggaacagacttgacttcttgatgggaagagtggtaaaatcacactccaaaaggacacatggaattggagggatagctatggctgtctttggaaacagtctaccaatttgtccttgaacaaattgtttaaccacctgattttactttctttgcctgtaaaataggaaatatagcatcaaccactttgggatgttgtaagtaatagattaagaaagtgtgtttagcacctcgtacattgtagtagaaacataacagaaacagcaaaaacacatattggttgagcccatactatgtggcagcactattacaagcacttaaatatattgctttatgtaatctttgtaacagcccaaagatacacgttatctttgagataagatgagaaaccctaggcacaaaaatgttaacttgcacaaggttggttgcatagtaactagtctgtctaaatcttgaatgtcttactgtctactttatccaaaggacactttttagttttttctctttaaactatatttgaaagtttacagttgatgttgctcgctcctctaccaaacactcctcctcccgtgatccctatgactcccctctgtacaatctttcctcctgttctcattgctaccttccaatctcctctttcatttcttcaactcttctttcttgaaggaaccatcccatgtggcaactcagtttctacctttccaatgatgattgccagtcttcactctctcctaaactctaggcttgcatttctaagtgttattagggtgtgagcacatatgacccaggtaacgttttgaaacgtttgtgcctttcacttctttcttattccattggttgcaatcttgtcacttaatacttgaaatgtttttcaaatttggatgtttctagcaatcagctaatgcctttggcctggtttaggccttcatcatctcttgcctggtttatcaaagtcattttttaactgaacttgttgctttcagttcctctctgacatgatggcattagggtaatatttccatgtgcttcaacacacataccttctcaccattactatatgtcccccccgccacccccccccagcatcacactatctctggtgtcaccttctctgttcatggcctttttcttcttctctaggggttcccccctttgaagaaacagcatctgctcaacctcccctacaggctcccttaaagctggtttctcctccctctgtttgtctctttgcaactctctggaggcatctttacctttacaactttgcattttctctgctattcccatgtaagttccctgaaaccctagtaccattcacagcaggatttcaaaggttgcctgttgcgtgagcattctataggatcccaaattatctttctgtgcaaatatgaattgttgtgatatgtccgtagagacggcacaacctcatggctaagaatgatagttaccagttctagagatcctactctaattgctctagagtgggggcctgaacaccagtattacaaaaaagacaaaagaaaaagaaggaaaaaagaaaaaagaaagagagaaaatcaaagctaccttcatcatgtatgaatttgagcaagtaacacctttgtgagtccccaggccccagtttctcattggtaaaatgaggataacaattacacagaccttgttgggctatgtacagaattaaatgagattatgtacctaaaaggcttgtggcacagtgacacacacacacacacacacacacacacacacacccagagtacttcgtggttatttctaggctttactgcttgaaaggctgaaaagatgggtggatgagaggtgccctgaggttccttccaactctccaagattctgtgatactcctccttgggtgctgaagacactttggcaatgtttggatttccaaacggttgcttagaaaactaagggacccacgaagcccaggtaagcctcagggtctttcccaggaatcgtttatttatttgatcttagttctgacctagagcctccaccttctccatccaaatcaccacagtggtcgaaaagggcctgtgcttgggaaatccttcctttgttggcgaatcttggacccaaaccctgcatttgggcatctgacacccataggcccatggttcaaacccaggcggctctttccaagttcgaagcagggactcggttctgcgcatctggcgggtgtgcccagattgtaaccttcgcactaggcatccaagaacgtgctttggacacactcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtgcacctgtagttactcctagtgaaagttgcaaagctcttaactttggaaagttcatttattttggcatttgaccaattaaggttggaggagggagttttagtggagccatttgcttttcctgaggtccctgggtctcccaggtcgtctcatccgttactggctactggaaaatgcattccttccaatgtttgcttgagatgtttctcacctggagaaatagttttctcgaatattctcccaacctaagtacttaccaaaacagcatattgtggttggattgttaaaaatgggatgagaaaatggcctttctcttgatattgctatgtataaatattggaaatgagctattgccttgcaaattatgatgtacgaattgaaaacaatttattatataaaaatccatttatccaaaagataaattaaagaattatttgatttataaagagtgtcacactgagccagacttaaatagcatatccttgatatattcaagatggtcgtgtggggtgaagtcatctgctaaaattttaaagtttatatcagattttccctaccagaggcttttttttcctattgaaaaagaaaaaaatattgttttccattgccggtggttatattaactaagtttattgaatgatcattgatatattacttcaaagtggataattgggtagagaaatactgatcccagtggtttccagggaggtttaatgtccagcctatgtgcatctcattgctggatgtgatgtgctgaataaaccacagtcccttatctcacaagctggagtcccaggaagatgtcttaagtcggggaagttcgtccttaagcagcagaagcaagacaattattttgcatgctttgcccaaagcaagtattagtattgaaacatctcacttccttgcctgtgaccagaccacgagttctccttgttatcccacataagcagttgtctttggctttacaagagaagatggatgaggcctatctctgaatcacatctttttggccagttttctgcttctactccttttaatccgggagctggatcctgtgttctcagattctcttcagcccctacaccaggcaacccctgagaaagagtcactaagtaggcttcttacaagaggaaatctgattccttggcggaggaatagctagagataggagtcgaccttgctgctctgagttcctgatagcagtgctctgctttcttaaactaggacacaagggttttgaagtagccccatgcccctgtggctctttggtttttgttggaaagtagccagctcatgaggacaggggtgggggttttcgagtgcaaggtgagaggaaatgaggccaaagattacatccaaagtgcaccctctccttcaggacacttctcccttcatttccaaatctcccttcatttccctccttccttgccttgccgacattaattcttacatcagatgcatttgtcttcatccctctgaagcaagagtgtctttaatctcggaaccctaaaagctgagtagtagaaaagctgcaccacacaacgccgtgtgaataatgtccctgctgttgatagtgtgaaccagaacaaccatgcacagcagccctgagacatgggttcctagagagagtcatctcggtaaatggatgacttctttttctggaaaggaatccacctgaatgccatgtcccagctttctctgttattgtccattcacggccaccctgtgatagctaggttttctcaagctgaactaaggactttggttataaaaggagaaaaaagatataatttcctgtggacagcaaagtgaccctgcatctaggaaatttactcattttttcagaggtgtggaaagactagggcacagaccagcgggcctgagccatcagaaaggttcttttttgtccaggtagttatagtgccctgttgggggagtaccgcacccagatttccctgacttggtgttcacagaggacttgatgcaattgtggtttaaaaaaataagcctaagtcacagttggaactgaagtgcctcacccagtctgtcatctgtaccaacttgtggaaaggaaagtgctgagtgtgagcacttttgtccatagaaagcaattagaatgctctgttggttgcctttatggtgttttatatgttaatgatgtgggacataaacttgcaggcctcagagactagcctttaaggcagagggaacagcaagcgcaaaggccctgaagtggtagcattattgatatgattctagaaatggtgacttcagaggtggctggagaggtgtgaaacagatggagagtgataagacgtgtatggtcaagagttagagagggtggatcatgcagagtcttgtaaaccattataaagactttggtttttactctgaatgagataggaagccattagaaggtgctgagcagagaagtgacaacactttgactgctatgttgaagagcaaaggtgaagtcagagaaaccacttaggaagctatttcagaaatccagacagaggtgatagtgacttcaacagggatagtggtaatggaggtgatgagaagtaattggattatgaatgcaatttgcaggtacagccgcaagtatttattgaaggaagagatgtgaaaggtgagagaagggcaattaaggatgcttcaaaggctttttgacctaaaaaattccatgtacaagtagaagtcttcaggaagaaggtaggggtgaggagggaaatcatgaggtttattttttattttattttaactttttgtaacacattaagtgtgtgatgcctctttagatagccaagctgttttacagttgaacagtgacctgaggtatgactatcctctttaatgtcaattgctctatgctcgtattttttaactggagacttcgctgtcaagaagattaattggttatagaacagtatgtattgttagaaggttttccttgtagggaattaaaaggtctcttaaatttctacccatggatcttgattatactttttttggtcaaaaagcattagtcttatctctcttctccatcatacacctttggctattaggaggtaaactagcctaacttatctagatccactctttccaaggaacagaaaggaggattggatcatgtaatgactaggtcttaaacatgtttttatcattttctttttaagtcttttcttctgtagggtgccaaccatgtctgtgccaagcactttatgtaggtcatttcactagtcctcacaagtcttttaagcacttatctgtgttccagcagcagcagcagctgctgggagcttgttagaattggagatctcagttatgtcccagacccactgaatatgaatctgtatattaacaggatcctcaggtgagagttgtaggcacattaaagttcaagaaccatggctaaaagtgattgatatatatgagtaaactgaagtccagagaagtaaactagcccagggccatggagtccatttaaaagaagaattgggtctaagtgaaagtagcttcttaggtagtcacatcacatgtactgaaaactgaggagttattgtcaatgaaaattttctaggtgtttttcataagagccacccttagacctactttctctcttctgtacttgtatgatggatttaatccctaagtgtaggtcacattctatgtagttgtaaagattcagcttagtatttttgattatgaattctgttatccaggatactggttttccattcatgttccaactccatattctggagatttttctgcatgttctctgtgtctgtacccaatgtttagaaaaggttcagcaggtcagagtatgaagcagagccttaagactcatgattagtgattcttctctccatgtaaatattactctattcaagaaaagctttttctaggtcatggttttcaactttggctgcacattaggaatacttagggagctggaacaaacaaacaaagaaaaaacaaacaacagcaacaacaaaaactaccaatgactgggctgcaccctagaccagttttaaatcacagtctctgggaaatgggcctggtatcagtatttttaaagttcatctattgattctaatgtgcagccaagtagagaacaacctttgagaccattgggcaaagaatgcatccgcctaacccttctcagctcagctcacatttgtttcttgcaaaattaggaaagatagtatcaaaaactaggaaccttgactgttaccctgtacagctagtgcccatatcaactgattcttaactttcttttcccaacgttatcctacatttttcttttaagggctcattgaacatatcataaggctctattatgtccaccaatctgagaggggaaaaaacaaacaaatcaagaaaaatcttgtctaaatagtgtgtcattaaaaggtcagaatatagaaccttcacaaatgtcaccctatgttaaattataatgaagtcacttattagaaaatgtacatgtaaaataataattaaatatagtttctatgaaaaaaatctccaaaataatcatcaagattaaatattagccttgattcaaatttttctaaggtagtcaaaagagaatcagtcttgaaacactggatgtttatgaatagaccttggtgtgattatgcacaatgggattaatttttttaaattaatgttaattgcaatcaggaaaaagagtcttctaaggaatgagtggcatattggatgcacaatatgtgaagatctaatttgcatttacttcggtgacatttcagggctccttcataaatattttatttaaacaagtgtgttttcatctctgcgggactcctctacatggaccagtgagtggtttagtcatgaggtaattatcaagaggggaaaacaaaagcaaattgtagtaaaggcatcacaggcagccctatggccagctgcctctttcaaaataaacaatcaaaagcacaaactttttgatgtgggataaactctcaaggaaaaattaaactgacacctaaaggaaatcatcctcaaattttctattatgtatagagcatagatgttgctttcactgaagtagcattgaggcacttttatgtttgtgctgcaagtgcaatttcccatatggttggcttaaaaacattcataatctcttcctaacaggttgacttgagggaactaacaagttcacactccaaagtgtatagagaaagtggaggagcttagtgagaggcataaatgggggagcaatctcacttttaaaaggacaagtatggagtatgtatttctattttctgaatgaagtttgaataaaatcaccatttgtggagaagttttcagttttcactgcaatcttggagcaataaatgtgcatcacgacttccttttctttcaaatgtttatttggtgggctctaggaagggctttagaccacatcaaatcctgaggaccaggctttgcagatctctttgaaatcttcatatggccttgcacatgtattttatcacacaaaaactttaaatcaacattgatagaactgcacttgaaagaaaaaaaaatcttctaggacatcaagatgacaaagtggaataagcaaggactttggagttagaatctgactgcacttactaccttagtgaccttgagtaaaatatttaactcttcattttattcatctataaaatgggagtggaagattgctgtaacattgtgcccagagtaaatgctcaaataaatgatcaataaattgatgttgttggtagtatcacctgcccatgtttcctttcagccgtggtccacaaacatgtatatgttttaccatttgtaattatttgtaggctaaatttactttctacttttttgtaaacttagcattttattacctcttattagctgtgtgttcctggacaagttatttaacctctgtgtcctcattttctcatcagtaaaatgtattactagtatctgggttactagttacccagataaaatacaggctgccagttcaatttgaatttcagataaacgacagggaatattgcatggcacataattatacaaaacaatcatctgttgtttatctgaaattgaagtagaactgggcatcctatatttttatttgtgatgctgacaaccctatactagtacctatctcgcaatgcatgcgaaataccatagtacctggtatatgctcatagtaattacacgtagtaaatgctcaataaatactagccattatttctattattataattttcccattgttaacacttattagtacgtaattattattgttgtgatgactatgtatattccaagaatgggtataccttttttatttaaccattcttttgaggctattctagcttgtaatttttttttagtgtgaataatgtcttgtatttatagtcccctgtttccttttgggaaaattttttcatgataaattataaacagtgagccctaattgctttctggtagatctatgttagttagtcctgctacatgtcaacagtaaatccgctagcattaggtgtataatgtgaacaaaaggttgctaatttaacatggtttaaacagctgcttagttgtttcaatttgtgttttttttgttggtaagactgaatattttttgttttgaaccttcttatatttactcttaagtgaattttttgtgttctctaccacattctctatcatgtaccagtttattttttgagaatcttaatgtttttttctaccaatttccattaattagaatgtaaatattctgtcaaattagctcacagaaggaatattgtatagtgaatgagctcaggttgtctgactataatcaacccattatattaaagtgtcttttgaaatttcaggggtggttcaataaatagggattcgttgtaacactcttttccaatgcaaaatgctgcatttatttatatgaaatatgaaaaagttgttataatttgaatctctttttctttatgttttctttcccactccaacctaccccaccctacccttgtgcagctgttacttaaccacgttgaattgatcaatcttttctagttataattaagttaaattccaaaaacatttattgagggccccttaagtgctatgtacaaggttgggcatctgtcattcaaagatacattagacatgcttactgcctctatggaattgacataaaacaataatggcaattaataaaatcaagaagggagatatctactggatacagtacagaaaaaagaggagagaagtaattagctgacttgagtggatctgcagaggcttcctacagaagtctattcttgggcagaagagtttgtctggaactagttggtgggaagagcattctaggaatttacaaaggtcctaacacagaagaggatggatcctgggtaacagtaagttgagtgtgtgttggcaatgttgagagatggatctgctctagtaaacaatggtcaaatcagatcacgaaagcccctgtatgccattgccaaaaacccactgaggactaactggagcactctgacacagaaatcttgaaagaagtacaatttatatcataagcccaaagcaaagcacaccaggagatttcagttccatgaatgcagcttctgaagtcttcctggttccttatggaaaatatactcaggttactggcaaatatgttctttctgtccaaggtaaggtcctaacagattggaatcaatgaatggaagtttacccattttagatccccaacatatcaccctgaaacccaactgtaattaccttgaatagttgtaaatactgcctttagcaagtttagtcatctggttcaaacatctggattccagatataattcctgactatgccaacagtgacatcttgcttccttgcctggttatttagtaatgaaaaagcagtgtgttcagctgcattgtaactatccagtctgtggatgtgcacagtctgttttctctgaagttatagggcccaagagggaatacgcatggcaggcctgcctagtgcccaccaagccacgctgtagagatagttctttattgtgtgtacagggtctgccaattaacaggcataattttaaaaaataattgaattgaatgcccttaagtgggtcacaggctgtccatttctaatatctgcctcctcgtccccaccacatacatgtacactttgcttatcacatttttgggacatgcctgcctattgaagacatcttagtttgtatcagctgtagcactgcagaaccattaaaagagtttacgctgaaaattcaggtgagttttatcccttaattaggtattctggagacaggataaacattgattggagaggttatagtaggggatgccagttatttgctcaccatatatttattgagcatctactaagtaccaggctctatcctaggtatgtacaaatgtagatacctagacacagtattgtacatacagtagggaatgaaacagaaaattaaaagtttgccctcatgaaacttacattttgggaaaatgataataggtacataaattatattgtatgttagatagtagtaagtgctaagggaaaaaacaaggcatggaaagagatcaagacataaagactaaactggcaccactgagaagttgacaaatgagtaaaggtcagaaggaaatgtgggagcaagatacacacgtagcagggggaagagcgttccaggcaggagagcggcgggtacaaaggtctcaaggcaggagcatgcttgacgtgttcagatattagccaagggttagtatgactgtagtgaggttggcaaaaagagagtagtagtagatgaggtcagagaggtgatggcagactgattgtaggcctctataagccattttaaaaaagtgacttttacttgcagtaagataggaagccattagcaagttttaacagaagagagataacatctgacttaggaagagaaaggatcactctgaccagcacatagaaaacagactataggaggggaaggttgaagttagggagaggagttataaagctgttgtaatcatgtaggtgaaagatggtggtggcttggaccagagtgatagcagtggagatagtaggaggtggtcagattctgggtagctggaaggtggagatgacaacatttactaatagatggatattgagtgtgaaagacagagaggagtcaagactaagactgtggcctgagcagctaggagaatagagttgtaggagaagtaattttgaggggaatgaccagcagctcagttcttgatgtgggatattggaaatgcttattagtgagcccagtggggatacagactagccgtctggatatatgagcctggagtttgggaaagatggctaggctgaaggtataaacatgggagtcatcagcatgtatgtgatatgggtctggctgaaattatctaggaaggcacagtgaatgggagagtgaaggggacccgcactaagttctggaactgtccaacggtaagaggctagagagaacttgaggaactacaaaggaagattaatgaagagagactagaaatgaaagagaaaatccaagcaagagtgttgacctggaacccaggatgaagaagaaggtgatcaaataagaaggaataagcagctgtgtcaagtgctactgttaggtcaagcagaatgaagactgggcactcaccattgcaggtagtgatgcaggggtcattggaagtaatgttgacaagcatttttgatagagaggtgggaacaagagcctgattggcatggctgtaaaagagattgaagggagaggaattggggcagtaaagacagaatagtcttttaagtttttctgctgacaagagcaaataaatggcatagtagttgctagtgagggaagtgagatcaagggttgtatttatttatttattcgtaagttaggagacttaacagcaccaaggtgaagggaatgactagtacagaacaaaaaatcatgatataggataaagaggggaggattgctagaatgatatccttggttgagaagttgggtacatttcccgaaagttcagtgtaggcatttaggcaccaaaggcacatagatgatatttaaaaccaaaaaatctagatgagcttactgtcttagtccatttgcactgccctagcaaaactaccataagctgggtagcttatgaacaacagacatttatttctcacagttctggaggctagaaagtccaagagcaaggagctggcagatgctgtgtcaggtgagggcgtgttcctcatagacagcaccttctctctgtgtcctcacatggtggaaggggtttctttcataagggcattaatcccattcatgggggctctgctctcatagtctagtcacttccccaaaggccccaactcttagcattatcatactagggattaggtttcaacatacaaatttggggaggacacaaacattcagatcttcacacttaccaaggggtgaataaaaatagaaaagaagtcaaacaactggttagaagtcagagaaatgtgcaggaaccaataaggagactgagagggaccagaaagtaacgtggagaaaaatcaagaacatgatggcttggaaattaagaaagtattcctaggtggaaggaaggatcccctgagttaaatgcccctgataggtcaagtaagatgacaaccaagaactgaccattgcatttaataacatgaaggctaattggtgaccttgaactgaatgattttgggagtggtgcctcagtggaactggtgaaagtctaactagagtctttctaaaagagaatgagaggagagaaattgagagaaaagagtataagccattttttggaattattttgtgaagggagaggagaggagaaactgattcaaaggatggcttttaaaggaaagacaaaataactgtatgtttgtatgctggagagagggaaaaatgatgtagaggattaaactgctggagtgatgtgctgagtaggttgagtaggtgggtttttcaacaacagtttgtttattgtcatgaagtcagggcagaatatatgggcacaggtgggcagatgtggtttgggaatcttgcagaagtttgccttctgattgctcttgtattcttggtgaaataggaagcagcaaggttataagctgagagtgaggatggttaggaagtaatggcaatttgaaaataagagagttataaatgtttaggagagtggaagagcaaatggattagggaaggaagtgtaattgccaggcaatactaagcacctgcttgaagttggcgatcatgaatttaaagtaatttccatcagcataggtgtgtgtgtttcttccatgttcagctcttttttttgcaggcatggaagagagggaagtttgtgtttaagccggggttgtgtgtatgagaacaaggaaagagtagcaaaagagttgagggtatgtagaatagattggaatgattgattctgaaatttcattggagtaaggagagaaaagcggatatgtaaaaggattagggatagtgaagacgtggtaggattaatggattgtaggtcctggaggggtggaatgcttgttgagaatgcagtgaggagaagggggccagagaatgagatgtttgaaatcaagattctggaggagctgcaactgttgacatgaccacgtccaggacatgatcatgagaggcatgatggggagagggggacaaatgattgaagacaggagctcaaagaactacaggcccagggttttggaagtgttatcgacatggatattggctttgctgagaattatgacaaaagtagttttggagagagtgacagtaagcgagcaactgggctctcccaggaatgtgggggaagcgacctgaggaatgatagatgtctgcaacaaggatgggcagttgtggtgtagtggtgtgttcagacaatatgagatttaaagctgggtgttttttaaagaaaacagcagcaggcagtaaactattaatttttacttaagcagaagtgttgaaggaatattttaagtcagtagagatgccttaagagatatttaagagataaaataattagtacaatgatatgaaatagagagagatcctgattcccaattttttttgcatatgtgcctggaaagatgtgcttataacttattaggtttaccacaggaagtcaagcacattttgtgggaaaataatgagattgattttaaacacattaagtttgggatgtgtatgacatctcatgcagatgtccagggcagttgactggtggaaaactgggaagaagttactggaaataaggagggtgaaaagcgattgaatgtcaaggccccttgcaactcaaagatttttgtaaagtggttcccagttccaggtatgcatcaaaatcagttaaggaacttttgaagacacaactgccctgtcccaagattgactaagtcagccttcaggggtgacacctaaaatacctctacacagctagggttgcaaatgacatgcacttacggccttcgtggtttacaattactttttacagccccttggtcaaaataaatgctcaaactgtctatgtaaaacttttataaaatattaggcaaggaaacccaaactcgaaaatgtgtttactatctatcatggattctttttttttttttttgtagccacagtgaattatctcaaattatttgtaagtacagctactattggcacaattactaataaattctgtagaaaatttagctgtaggatgtaactgtagtgtcctagccctaagtaaaatcatggtcttctttatcgctaggcaagtaatatgattatcatttgttcttattttaggataaccatacggtacataaaccctgtgaaaactctaactaggccatgaggttagagaataacatggttgcttgattcctgtaggctataaatcatcctagccaatatgctcacttcttgtcagaaaaacctgtgaaacagagaaagaagctggacaagaatgaggaggccacattagaatcacttttaacttgggattcagaggatcccaagttaaacatatttccattcttatttttttagataatatggatgtcaattgttggcatagctgagctagctctgaaggcttcccaaattatttcagagggaatgagaaaacagtgctgcttgctcttctttaatctgttccaccgtgactgctactttagatttaatataactgtaatatcccgaatttataggtcatccttcttctggggcttttaaagtactttgtgtgtattactttaattttgagggaactcagattcatcatcttatggaatctatttcagagggaatctacaaagagaactagaaagtcccccaaagtgtttcttttttttcttccagatgcctttggtaggaacattcattgattctaactccacactgctttagaggccatttatgtgtggattactgtaggctgctctgggggaaaatctaatccccacaggttcagttagagaggatccactctgcacgctgataaagattaaaactgcagctcttttcgattgcattgtcttctttttttatcttttaatttttgtattatcttatgcttcagtaattcaatcacatctgccttcccagtgcctcagtatgtggaaactgggaagttaaattgggcagagtaacaaaacaggagctctacttcatatgcctttgttgtaaaatgtgatgtcttagggtttgcagtggtgtcccatagtgctacagacaatcatcagatttgacccagggaaactcctggagaaaagtgagtagtaaatagtggccttaatgatgcaatcagaacatgggggattgtcagaagaggatcagagttagctttgtagtacttgattccttaaatgtttaggaagtagtttcattaaatatagtaaaacatttgtctactgatttatatagtttttaatcttctctttttccaaaacctcatgctaattaaattaacattcctataaaaaacatactgaatacaatatatatcattaagtgagacttattttaggttcataaatagtacaataaactgtaaagacttagaagtcataaacttttacttttcattaatgaagcaatatgtgaatatataaaaccaagtttgttataactttataaattagaaaaattagaattatgttggagactacaatacttcactgatagaatacatcaactagactaaatacatagaggatagaagttatagagttaaaataataaagaaaaatcatgttcacgaaacatttaaaaaattaatcagcacatgattaattttttagacatgacaataaaaaggaaaagttaaatccaacaggtaaaaatcgcatgggccacatttactgaccataaaataatcagtgagagattaagaagtaacaataacaatgccaaaactctaaacacttaaaaattgaactctttcagagatctcttgagttaaaaaaaatcagaaatggacactgaaattatagacattgagaatacaatggagtataaccaaagctatatctagatgacaatttctaattctcagttgttaatagcaaataaatacagcaatagaaaaaaaaatgcattgaagttaagagcctaaaaatagaaaggtaaagcaaatcaaaagagaaaaaaaaataagagcaaagcatcaataaaaccaaaagaagaaattactgaattagaaagtgaaaaatcccaaagaagcagtgttaataaataaaacccaggtgtgtctttctgaaataaaaaataaataaatattgtgctattctgatcaaggaaaaaatgagaaaacacaaatataaagcaaaaagaataagaaagaggatttaataacagatacagaagacaatagaaagcacaagaaaatggcatacatgccaatgatgtagaaatacaaattgagtggaagtcataaacatctcagagtgagtataaaaatatttagaagaaattgaaaggtagtcaaagaactttctgtgtaaaaaggtataggcctaaatatttttataggttaagtttaacaaaatattaagtactacatcagccctcttatttgtcggaaccacaaatagtcattacaaatttgttttaagttgtcattgcaacaaaagttttcagtgagcacaagaattaaaggtcatcagcacttccattaacaattactgttaatacttttaccagaagtggaattgctaggcttatgcacgttaaatattttgatataaaattatcaaattgtcctctagaaaggtttaacaattcatatactgtaaaaactatactgtggcatagaaaaaatatggaaggcatcctaatttactttgtgaggctagtatcacactaatatcaaatctgacaaagacaatagtaaaaaaatcttgataccaatctcagttaagcatataaatatattgtaaataatagaaaacaaatacagctttgtattaaaaatactgatgtactgtaacctggtaggggtttaagactacaggaatggtaaagcactaggaagcctagtattacagtaataggttttttggttgttgttttatatatataattattttaacttttgacgatgtatgcaacataagtcacaaacttgacacatttttctctatctccagtcattctctggttttaaaaatataactttatcgagacgtgttttacatattgtagagttcactctgaaagtgtacaatggaattattttttagtaaatgtatgaagttgtgcaagcatcactataaatcagttttagaaccttttcaacattccaggaagtttcctcatatccattctctgttaatccctgcctcaggagactactaatctactttctgtctctattaatgtgtctgttctagacatttcatataaatggaatcatacaatatgtgatgtcttctgtgactgggttccttcacttagcataatgtttttgaggcctggctatatcatagcacgtgtcattagttctttcctttttattactgattagtattccattagatggatgtatttcattttatttattcatttaccagctgatggacatttggcttttttccaattttgtgctattgtgacatggcaatatagtatctggtaaagacagcatttcaaatcagttgggggggtgggaaatgggctattcagcaaatggggttgagataattgagtaactatttgggaaaaaacattatatgcctgctcctgaaatttttcatgtggtttaaattttacaaatataactgctaaaattccaaaggaaattatgtgataatcattttatcatcagaatactgtatagatgacagcaaaacaataacagcaggttagacacagaggtaaatttttaaaattctttcatgtaaagagacctaggagtagtctgcccaggtctgagagtctctaggtagtcttaagattcaggttctttctgtctttctatgtttgccttctttagtgcattacttcaaattcaaagtcacatcatgggctaatatggctgctggaattccagcacttacatttacatccctgagagagacaaaaacctcactttcgacctgagtctactcttctagagtaacctttctcgaagtcccactctatacttgtgctttcatctcattgatcagaatttagtcatattgccatccctagctacaagaaggttgagaaatgtagtcttttagcttgataaattgtcacttcaaatgcaatttaagttgttattttggaaaaggggaaaaacagatatggggtggcaactaccagtgtctgtgatctttgtagtaggtgaagccttccttagcgtgaccctaaagccaaaaaccataaaagacaaggttgacagattctgagaagcacaacagcaggaacatttttattttgcaaagttcattatcagcaagacaaaccaaaaatgggacaaaataataacaatgaatgatagagaattaacattcttaaagtgtactgctgaaatacattaattagtaagacatttgactgtctgtgccttttggagagagtgtatcaattctttggtaactccttaaatgtacaataataccatattgacaatgtttattcttattatataaatatatattttaaaccatgttgaccttttagcaagaaggtacatttttttgtatggggcattattattttaattctctcccctcaagggcacattttaggctcatctgttaaatgcagctcataaacgctgttataggctgtttgatttaggacagattcagctagattacctgaatactcaattaactgccacagtgagaatcgtttgctttcagatcgataagaagatcaaatcagtagccattctcagttcagtgcttcatcaggaagtgaattaaagcaaacccattagtggtcatttttctaaatgctaatcagtgaatttcaaattctagaaaaaaaattgcatgtttttagtggttattatagatgagtatcttgaactgagttcaggacttcaggacattgaaagggggcctggtttctagccatattacttagacaacaataattcttcacagctttctgttaatatcttctgatttaacaggcaagttggagccaagtggcctttggctatttggtatccttggtaaccactgttagatgatgaattgaattagttaaaattaatttcttgtgaaaagctgcttccatgagaggatactgactttgatgtttagatgcacaagacacagacacacacacacacacacacacacacacacacacacacacataatgtggagagagtgtcatcaggtgtggagagtttttgcaggtaactgcaaagcctaataaatgtaaaagtgagaaagacgaaggaagactgcaaagggctctgcctctaagaactgtgcttctgcttggagagggaagacttatataaataaaggaatctgaagcataatagtcactattatttggctggtgaagtagcctttcttttctcacatctgcgaatgttaactgtcatgacaaagctattttattgttatagaagtttgggaaaagatggagaacacattttttcaatataaaataatataatatatattttggctccaagcccacttttgatgtcaatttaggtagcatttttctttcatcctgataggtgcctaacctgaggaccatatctgctacaaactctgcactcccagaagttaacatttttagggttattgctagaacatgcacagcccagtgctggactgtgtacaatggattgctatttgcttcaaaagcaacactcctatatcctgttgggtctgtagcaagagcaatccattgtaccaagatgtgtcccaggtccctggcccaggcccgccagtcatgcatttccctggaggggcaagggagaaatggatgcccctgatttcagtcctacatagaattttaactactgctgacttcagaatattctgcttgtttttttgttttgttttgttttgttttttgagatggagtcttgctctgtcacccaggttggagtgcagtggcactatctccgctcactgcaagctccacctcctgggttcatgccattctcctgcctcagcctcccaagtagctgggactacaggcacgtgccaccatacctgactaattttttgtatttttagtagaggtggggtttcgccgtgttagccaggagggtctcaatctcctgacctcatgatctgcccgcctcggcctcccaaagtgctgggattataggcatgagccaccgcacctggcctgtgcttggtcttggatgaactataaggtatagatatttagagaaaaaatgcagaagctgagctgtaagaaggtaaatcagagcttcatgtataaattggactcttagagtcttttaccattgaatctgcttttgttctacatttaaatacttcctaaataaacaagagcagcacatatcctgggcagtccatgtaaactgaattcaaagactgcctcaccacttaatagttgtataatctggggagaattacctaacttcttggtgtcttaattttcttatctgcaaaatgaggataataatgcttataggggaactgagggcgtgagtaaggtcatgactttgggacacagcatgccgtttagagatcaattagtgttagttctattattaatcccctcagtggaagcctttttaatgtttcacaaaaatcggcataactgacttctgtcccattctttatttttgctttcttttacttcctccattaatctcttttcttttcctccacccaccttctagtgcccttatccattattgttttctctcctcttttttcatcttatcccctcttacttcattttatcctccagactttttattggtgtttttttttccttctgcataccttaagtgacaatgtaatgcaatctagctattcactcatcacgtttaacaggaacttaccatggactggtcactgtccttggtgctggggttgtgaaaaagaaagacatgatccttgtcctcaaggagattaccttttcgtggaggatacagacaagtaaacaggcaattgaaactcagtgcaataagggaaagtgtggtttgatctgggagcacataggaggggcacctatcccaaacttggaggaagtggtgtcaagaaaggcttctccagagaagaaataaataagctctgaagtgtcatgggaatgagtgttccagtaaagcatttggaggaagagtttctagtaaacaacatgtgcaaaggtttaaatgcttgaagtggcatgtgaccttagggaccctcaatgagttaggattggtggagttgaatttggaagttagagtggggggttgttgatgtaatgacagttaaagtcagagaggtaaataagggtcttgtgggtcatgttaagaatttacattttatcctaatcttaatagttatctatcttatgatagaatctatagaacatgaaatgcagtaggagagtggtataaaggaaatctaaggtttctgatttaggcagctgggtcatataaaatgcagaagtaagagcaggtagagggaatgagaaagagagactgaattgggttttagaaatgtgtatttaaggtatgtagtacctgtagttgtaaatatgggcctgaaatgaaaaaaagagtttcaaatcttattttgaaatttgatagtgattgcattcattattctatactgaggtttttttcttttgttagtgtttttgttttttgtttgtttgttttttgactggttcttctgaatgtccttacattttgatgggcatagttaaggaattatggcccaactatatgtagccaagagagcaaagtttaagaagaacatagttaaagtgcgagagagaacccagtatttatttcttctgaaggcaattaggaaaaaatcaggagtgtttaccctctgatatcacaagagttgcttaaaagaacttgaagattgctgctaagtgagtcccatggccaggacatggcctaatggtagtctgagggaagtgtatgaatgaggttttggggtgagtgataagtaagagcttgtcctacataaactcaatctccagtattagagaggtctccaaagcacctaatttcattgaataaaataaaattattactggatttattttaaaatctttggagtttacagcaaactaacacaggaacagaaaaccaaacactgcatgttctcactcataagtgggagttgaacaatgagaacacatggacacagggaggggagcatcacacaccagggcctgtcagggggtgggggacaaggggagggagagcattaggacaaatacctaatgtatgtagggcttaaaacctagatgacaggttgataggtgcagcaaaccaccatggcacatgtatacctatgtaacaaatctgcacgttctgcacatgtatcccagaacttaaagtaaaacaaacaaaaaatgtttagagtttatatttatttctggcttgtatgctgtttgagataaagtcttgtgacaagtttattacctgctgtgctatgtagaactgcctttgattagtcagagcctgacttttcttttccttccagtggagccccctcattaaggcatttcaagcttagttgactaaattcatgtttctgtaatacacatcagtcatgattctacactctttccttatatctgtgtgaagttcatcttttttttttttttttttttgacagagtcttactctgttgcctaggctgcagtgcagtggcacgatcttggctcactgcaacctctgcctccgggttcaagcgattctcctgcctcagcctcccgagtagctgggattacaggtgtgcaccaccatgcccagctaattttttgtattttcagtagagatggggtttcgccatgttggccaggctggtctcaaactcctgacctcacgtgatccacccacctcagcctcaggaagtgttgggattataggcatgagccactgtgcctggccaagttcatgttttaatgatgttagtttatttagttagtttcttcctatacagctgggcccttctcttcatcactatgcaggtcttccttttcttcacttctcacccaacctgatgcatagaaatggacctcagcttgaacttttggaactgatgctgtatagtatagatggaagaatgaggagttttcccttacaggatgcagcagccacacataaggccatctgctcagaaaacctagcagtgggtccccaacctcttcctcatggccacgttcctcagtcaacaagcattatttgaagttttggttacaatgttttccatcacacctgattcttcacacagattttgggagagcttcctggaagccacaacccactggagtgaggaatgctaggtgatctagtatctccatcctggccttgtaaagtttgggttgttggttggaattagttcttgcacaccaagactgcacagagccagctagcagagtgtgcagggcctctgagccagttctgggtgtgctccttgtccaccagccctgctccagcagattctccctgactagccagctatgaactttgccagtgtagttattctctctactacctctcccctctccaaatggtgtcttcctcttcacagccacactgctcataaaatagatttcctcccccaccttctccaaaccaccttagtccaattcccacacccaccacttctctgaggctgctgtaactacagccatcaatgacctgctaattgctaatcccagtggacacatttcagtggttggaatcctgctgtgtttgaaacagtgattactgcttcctgttctcttgaatttgcaacaccaaatcccattctattttctttcatgggtttcttttcttctacttgccccttaaatgttggcattttttatattactgtgacccatttcttctgtcacttatgcatttttcccaagttgtcctctccaatcctagaacataccagccttcaatatactgataattcaagattcatattccagcccagactgctgaagttcagacctgtatatctagccacctcctggacatctccatttgcatagatgaaggagcctctaaatcaatgtgtccacaacccaagttcattctggcctttccacttgctgctgttcctccacctgaaatgtttttctcacaggccccgcgtggctcactgctcacttcatttatcctctctgttcagtcagcaccttccccaaaagtccccatatgtgccttttccttccctggctttatttctcttcagatcatatgtgtctgaatctatataatatttgttacttgtttattgtttgcgcctcacccccaactagaatgtaagctctatttatctgtcttgttcactattatgtttgagccaatttctggtgtccaaatattaagtgagtgaatacaccatcccccacccccagactgatttctgtatgttttatcttcatgggtgacaccagtcccaccctcagtcactcaggttggaaatttggagttatactagaaacttcttttaccatcaccacatcctcactttcccatatccaacagtcaccagttcccgccagttttatctcgtaataatttctcagatctgtcttctatctctgtccctatgatcaccttatttccagccatcagacctctcttctgtcttattgcacctcttaatgtgcttcctgcctcagtttttaaccacccaaatccagcctcaatggaagccagagtggtctttctaaaaagcagatgtgaccctgctgttttcctatgtgaaactcttcagtgggcccattcaactatgggatcaagtctaagctctttagcatgacacgtgagaatatggtggaataaggtggaatgaatctggtggaataaggtgcaccccttgcgttagactaactgcagggtgtgccccacagtttcctgcctccattcttaagctgtcccctcagcctaaaatgattgtctttcccctctgccttccccctcctggtggattctccctcatcattcttttaagcatcagttttggggtcacctaaactccctgtgctcttttgcattttccttagcactgtacctatacttaaaacattatctgccagccaggcacagtggcacatgcctataatcccagcaatttgggaagccaaggcgggtggatcacgaggtcaggtgttcgagaccagcctggccaacatagcgaaacctcatctctactaaaaatacgaaaaaaaaaaaaatagctgggtgtggtggcaggcgcctgtaatcccagctactcgggaggctgaggaaggagaattgcttgaacctgggaagtggaggttgcagtgagccgagatcgcgccactgcactccagcccaggtgacagtacgagactctatctcaaaaaacaaaaaacaaacaaacaaacaaacaaacattatctgccatgtgtctgcctccttcattagatcagattggaactcactgagggaaaggactgtgtattatttatctttttattctcttcatctaactccatgactgaaacatagtgaggatttgataaacgtttgaataaatgaaagaataatgaatgacccatcgagatagatttctggctgaattctggtcattgtcatcaagttatggcataaaattacatttccaaaatctgaaaaatattagtgtaatctgcaaaatgtgaattcattatgtgctgtgtgttactgaacattgcattgttgcttttcagcaagtgctcatgtcttactttccctgttgtcctattaagttcaaaagtcgacttaacaaaatctaaacagaaaaaagagaatgggggaataggaacaagagaagattacatccatttttttttgtcttatgaatttgaagcattttctcaaatgtgaagaaaagggcactttttcagcagtaaagtaattgtgtttttattataaagtgtattatgttaggcatgtgggcaatatgactcaatgaatagttcttcaggattagtgtatgcctagttgaaacttaatgctctttccctcagcatgcatgtaggatctgaattttcactgtgaaagcaaatgctcctgttggagacctttatcatcaacttgttggaattcatgcctagaatattttaagttgaacaattctatcacagtggcatgcatagattgctgagaaaggcacagtgctaatgatgctgtagacatcttaaaagctaggaatgctccatgtaatgtagatggcagagaaaatgaagtgtgccagtctgttttctgttgcttataacaaaatatctgaaactgagtaatttctaaagaaaaggaatttattttttacagttatagaggctggaaagtccaaggttgagaggtcacatatgatgagaatcttcttgccagtgggaactttctgaagagtcccaaggtggtgtaaggacccagaaatttctgatcttcttctacatctaattgccctgggtcgaggcagggtatcacagggcaagggggctgagcatgctaatgtgttagctcaggcctctcttcttcttataaagcaatcacttcccctcccatgataacctattaatccattagcccattaatccataaataacaaattcattcatgaagacagagcccatatcatccaatcacctcttttaaaggcccccacctctcaatactaccagattggtgattaagtttcaacatgagttttggaggagacattcaaaccatagcaaccaatcccaaactgaggtaagtgaagctgcacagtggttttaaaactgttttactgagccctaagattctgcaacattgtcttggggccacctacaggtggacttaagaagtgaaactgaagctgcccctcattcccactgcaaagagcagtaactctggtacctggtttaaagagggtggttctttattacattttacttgatatttgacttgatttagttgaatataactgttgttgtgttctataatacggagaaaattttgaatgaataaaactaggtatagttttaagtagcaagattccgagtagcttaagaggattaaaaaacaaggaagatattttagattctcacattctaattcttacaagtggagaagaaggggagactgcgttaacttggaaactaatactgatgagcacaaatgtaaagggttatgagcacacaaatgaagggtccatgcactacacctaggaactttaaggaggcatattctgtgaagatattttcaggagtgctgatacccagaaagaattggtgttttggaaacatctagagaatagtcaaaaatgtatgttaatttatgtttgaatcaggaaggaagatatctctctgcctagggagagggagtaatgataacagatgccagaaaacatccaacagaggcaggagcaatgccagcagataaagttggggagctggcccagttctcaacagtggagggtatgtggaccctagaaactcaaggcttgtgagcttggtgtccatctctggcaaagtcctaagccaatttagcagatggtttgagagcactaaggaaagatgctggagagttagcttagtaaaacaaagtcttggtaaacttccatgcttctcttattgatagagtctgtcttgacttcagcaatatttttattgggcagtttatgataaccaatatgtctttttttccgttgagaacaaaaaaactgactcaaggaaagaataggaggggtgaagctcatgccagagaagcaggaagatacttccttatgggcagcttgatggagccacatagaatctgcttaaggcagcgggaagcttagataatctaccagctctaggtgcagagtgtcccctaatactgcatttccccaactgagaaccatgaccacctcccgccttcagagatactttggggtatttatttaaaatgccccatccagaatcatgatctctggaggcatagcccaggaatctatacttttaacaagcttcccaaatacttaccaagcacatataaattttagaaccgttgcttcaaagataagattatttgctgtgaggaaagctacccagttagagaaacagagaaagtctttagttgtttcataagcaggttcattttttatatatgattgtgacccagaaatttctgatcttcctctacatctaattgccctgggtcaagcccaacccaaatgccatctggtgacagccacttatgctgcaaaagcagagctgatgaggcaaatcttttgagcagtaaaatgggattttgcatcaggtaaagaccttaggtgaagagcaatgaggcatactgaaagaaacttagttctacacaattccttgagaaactcagtctccatgctgcctggattgggggcagggatgtatcagtacatctgtaaacaactaattctccagaatagaaaaggtatgcataaatatacacgcatacgtttattttaagtgttactcatataaatgctgtgcggtgcacaattcataataaaatacacattgcattttattgattacattacaattgattctcacagaatgcttttcttgatttttgtcaaactcctgtatccatagcaaccttaggttgcagctgacaaatgagtgtaggcccaacaagcctgttggttgatagcttcatttatatgaacaagtaagaggaaagtaaaacaatgacacatgtcagaacttcacttattcatcaataatctgagcaacttcttgaatcagataatagttttttaatattggaagaatatgtcctcaatattttgtgctgtttacaaagtaatgtctacagacaagacacacttttcatctgttatttacattttctccagcactatcgtaagactttcataaaacgtcactttcagaagaccttaacaaaataataaataaaaccttggtttgtggtgtttgcaagttttgtggtataagtgctcccagcctggctgttttcaagctaccaataagatattgctgaccgtggagctgggaagagatgtgcagtagtgcatcaatatctggtatttccaggtggagaagaagggatactatagatgtaagtactatagatgtaagtaagatactatagacgtaagtggagaagaagaagatactagagatgtaagtaacactgagagcatagacaataaattgtagttaaatgagtaggaaatgataacttttgagaatcatctttgaatatcacctttgacttttgaatattacctttgttttcagcatagtttattgaattttacatttatataatttagtttttcatggtggctgtgtttaataatcagctctcaaaattcctgaaaatttaagttgattcttatgagcttctgtgagctgagtctaattcactactgaatgggcagattttctgaactcacagatatgtgacggggttatatccctgcttttatgcaggagcatatgtatgatactcaggcacatttctatatttgcatacaaatgcagctcctctaaaccagagcataacagtatcatgtctgacaaatgtgtcctgcccctgggcatcacaatgagaggaattcctaaacagatgagatcagatccaatagaacaggtttcctctgtcatgtctgggaaactatttatgactcatactctttgccagctctgtgttttgcatcagtagatattctgacatgtaaaggtacccctctcatgttgcatcctactgatttcagcaaaactgtttttgataccttgacactttctacaagcccttcagaatacagtgatgttatgatattactgctttttacatttccacttcctttcttctacacctgttctgtaaaagggtattcagtttgcaattaaaattcgatggcagcctagctgtggccatgagagtagatttttggagccatttacacaaagccagatatagaatttatttgatgtgtaaaaatttttggagctgaaagtttgagactatctgccacatagaaagatatgaggatttgagccaccacttttgtgtaaattcttattaaaaacagacagtgctgtgcaaggttgtttcttggatagaatttttggatggtaatagaataagctatatacttctagtgcacaattattttctctcttcctgttttctcgctgttatgcttgtaagcaaattgttaaataagttcattctgctccccaagagcatttccagaagtgtcttggaacttcccactgtaggtacctgggctctatcagtattttctgtactgacctttgtaattatgacacaggggatacttaaacaggactttgcttgccaaacaaatataaacacaaaattgctttaagttgctaactgttcttcctgctgtggacattggccatgacccagcaacttggctgctatttcagccataagagattttctgtaggtcctcaaatactatctcaagtaaaaattcttatggagtccactcattccaggttagggtaagaaaacttttctcctaataatgtaataaaattttactttataaaatgaaaataagcaacattctttcatattataaagaacataacataaaaccaaataatcttttggctgagaggaaatgccaaacccatttcagaacatttatgttatttttccatgctctcttcaagccaagttgattgcatacaaatctcctaaggggatgtgcaactgattccatggtcctggctcagggcaaaaaaaatggaaccatgactgaggggttttataaaatatcctttgcccaggtaaatatggaggtgtgagttcacagagacagtcaggtagacagatgtcaggttaggaactccaggctccaaggtgctgatgaccagcagtacctaattacagctcctctagtgtgcacctctctgagtactgtgtgcacgcttgccagcctagaggtgtcttcagtggccatcggggtcctccaacctggagtagcctgtaggcagcatggtgggaagtccctgagaggagaaacattcttaggtgctgtcctgtgctttctggcagttgtttcccttgagacacagccccttttgatccctttatggatccctgtgagtcagaatttggaatgtttcagcctcctaatttaaagcatgttttctttaaattacatttaacttctctacattttataatttttaataataattatccaagtaatatatgcaccgtgttaaaacacacacacacacacgcacacacacacacacacattaccaaaggagagagagaaacagagattgagagagagagagagaaagctttaatttagaatggacctgtgggtccactcccagaggcaaccatttttatttacccttttctagttttaggtttctgataattcccactattctgtaaataatgtactttaatttttggtttaccaactttagattatatatgtatgtgtgtgtatatatatatatatatacacacacacacacacacagcctaacatatatatttatatatatgttatatatgttaagctgaatacttactaagaagcagctatttttgctcccaaactgaatcaaatgctttgtaagactcagtgaagttatttttaaaaatgctggtaaattaggatggagaaaaactgtgaaagattgaagacagtggtaaaaacctagaaggattttcttctcagattgctccacaaatatttttaatttcttattctactttaaggaaatgcaagttgaacacacagacaaaactgcattatgggtatttttttatgtaaaaagccaacacaaaaatataatcagaggacccatattcaaagaaaagaacattaccctttgtcaaaagctcagttaatgttttcagtaaaaataaaatatttacattaaaataaaataaggtttaagcggaggcagtttttggtttaactgactttttcaattaactgatcccaatcgcattagccaagaagactttttaatattagagtacagtggttaagagtagccttcagcaaattatttcacctttctgtgcctagattctttatctgttaatttgtagtaatcatgggttttcatgataatcaatgaattgccttatcacatcattgacacttgttaggaactcgaatgtggagctattgttattgctattacaatattgtaattttgtaaaaaaattagtaactacccagccttgaagtgtgattggaccctccaaaaaggcaacacagttttatgctaatctcttgccacttgaagatttctgttccttgcatctaaagtcttcacttatctccatcaattattcaaaatcttgtcatgttctaattgacttggtatttggctattaactttcctttatggtattatgtgtttcttaggctattttataagattttgtatcataaaatacttaggatatttcataaacaaggaaagcatcttttaaataaaagcgtatttcttcactatattgttaagtatatccagcctcttgatcatacattttgcattgagaagccaactttcttatttttgacagtattcttctagaaagatactctttaaacctgcacagagctgagcctcaagttactgccacttgaaggttaggtacattagtttccctactttctctttcttgaattcctttttccttaattagttggagtacattctcaagtaaatttttcaaaagagaaacatggtatgtaaatgttgagccctttacatttctaaaaatgctcttattttgtcctgatattaaatagtgatttggctaagcatacattctacaatgaaaatcatgttctcttagtatattaaagggattgtttcataggcttctagcattctagattccttaagagaagtctgaaggcagtctgcttctagatctctttatagtcttctctctcaccttgaagttctgatatttcatagcagtgtgtctgggtgtgctctctttttcattcatctttctcagcatttcctaggacagttaataaaaacaagatgtctttcattctgggaaatgttattttttttgccaatttcttcccctccattgtctgttttctcttcagggagccttctaggttagtcttctatgtttacttgctcctttattgctttatctctctttgcttcatattcttagtgtcttcaaagacaaaagtttacctcagagtactttagtatgggtgaaccttttgctccctcccctacttctccataattttttctctttacaagacacattcaccattatttttcacccactctatcacctaactatggagtttgggcattgagaaacaaacaaacaaaaactcagcatgagtttacctggaccattgggctttatttccacctccctaagacaccgagctatccctagtacctatttcataggaatttgggagctaaagatgaggcaggattctttctcctttccatgactgtattagtctgttctcatgctgctgtgaagaaatacccaagactgggttatttataaggggaagaagtttaattgactcacagttccacagggctggggaggcctcaggaaacttacaatcatggcagaaagggaagcaaacgtgtccttcttcacatggaagcagcaagaagaagtgcagagtaaagcaagagaaaagtcctttataaaaccatcagatcttctgagaacccactatcatgagaacagcatggaggtaactgccccataattcaattacctcccaccagtccctcccatgacacatggggattatgggaactatgattcaagatgagatttgggtggggacacagagccaaaccatatcattccaaccctggcccctcccaaatctcatggcctcatatttcaaaacacaatcatgcccttccaacagttccctaaaatcttaactcattccagcattaacccaaaagtccaagtccaaatctcatctgagacaaagcaagtcccttctgcctttgagcctgtaaaatctaaagcaagttagtgacttgctagatacaatggggtccaggcattgggaaaatacacccatttcaaatgggagaaattggccaaaacaaaggggctacaggccctatgcaagtctgaaatccaacagggctgtcattaaaccttaaagttccaaaatgatcttatttaactccatatttcacaggtcatgctgatgcaagaggtggattcccacagccttgggagctccacccctgtggctttgcaggggacagcccccttcctagctgctttcacgggcaggtgtttagtgcctgtggcttttccaggcacatggtgcaagccatcagaggagctatccttctggggtctggaggatggtggccctcttctcacagatccactaggcagtgtcccagtggggactctgtgtgagggctttaaccccacatttcccttctgtacttccctagcagaggttctccatgagggctccacccctgaagcaaacttctgcctggacatgcagacatttccatatatcctctgaaatcccatgtcttctgcacacccataggaccaacaccacatggaagctgccaaggcttggggctggcaccctctgaagcaatgtcctgagctataccttggcctcttttagccatggctggagcagctgagatgcagggcaccaagtcctgaggctgcacacagcagggggggcccaggacctggcccaggaaaccatttttccctcccaggcctcaaggcctgtgatggaagggactgccataaaggtctctgacatgccttggagacattttcctcattgtgttcatgattaacatttggcttcttgttacttacgcaaatttctgcagccagcttgaatttctccccagaaaatggctttttcttttctatcatattgtcaggctgcaaattttccaaacttttatgctctgcttcctcttgaacacttcgccacttagatgtttattccaccagataccctaaattatctctttctagttcaaagttccagagctttctggggcaggggcaaaatgctgccagtctctttgcatagcaagagtgatctttactccagtttccaacaagttccccgtctctatctaagaccacctcagcctggacttcattgtccacatcactatcagcattttggtcaaaaccattcaacaagtctccaggaagttccaaactttcccacatcttcctgtcttcttctgagccctccaaactcttccaactgctgcctgttacccagttccaaagtcgcttttatattttcacatatctttatagcagcacctcactctctgcggtaccaatttaccgtgatagtccattctcatgctgccatgaagaaatacccaagactgggtaatttataaaggaaagaggtttaattgacccacagttctgcagggctggggaggcctcagcaaacttacaatcatggcagaaggggaagcaaccacgcctttcttcacatggcagcagcaagaagtgcagagtgaaggggggaaaagccccttataaaaccatcggatctcttgagaactcactctctatcacaagaacagcatggaggtaaccacccccatgattcaattacttcccactgggtcactcccatgatatgtggggattatgggaactacaattcaacataagatttgggtggggacacagagccaaaccatatcaatgcccatattaaattagtggctatttttataagtccttgagtgaaaagttcagaaccctgaccaacatcagtctcagcaatgtctacttcttctcaagacaacattaagtaataattggatattatcacccacactggtttctcagctcactagtggttgtggtctctatccttagttattcaaaggccacagtaaaaattgagttactcactatcttagaaggcgagaaggcattctctcatgctgaagtttcttactcataacctggctattgcgtcttcctcttgagataatcttcatcccttttttatgacatgataaataatgatgacttttaactgcaactttttctttcttattttgggacaatgagataatggctctcttctagcttgtaacaaattatgcagcagcaaacatctaggaattcccaagacaatatggaatttatgaaaagacaaccaaacaccttatgtttttattgtttccttattatatatttataagtttgctgaaggaagtggcattatttaagccctgtgcaccatgttttccaagtgataaatagcaagctatgtgttcccagtagagagaagcatcataacgtcatggcagatggcagagatgctccctacacttagctttataggattatccaagggtcttctgacacagactcctagaggcacaatagtgggaaataagtatgtaactgtcaggggcctgggaaaccctgggagggaccccagactcttgaggtggaggggcagtactccatagaagtactttgacagaagggtttgaaagggactatgtacctggctattgttggtatttggtaaaactatggcattatatgtatttgtaaaaaaaaaaaaactcttcatctaccttccccttccttagttgattttcttctcttatatttttatgataatgtctcatcctttctaatacctcttatttctgttccatttattattatctaacccaaatatctttcagaacatcacccaaatgtcttccagaacttcatgcccttttgggcctgatacattagcactggatatctaggcctactggatcattaccccttatctgtccacagataggaaggacctctgtcctactacttcttttgttttcctgtgagtcccccattggggatatggtggagaataacatcttacataaaatgagccattttttttggctttgctgtctttcatctgagcctactgcatttgtcctccttctcatttatacttgttcttactatttctgtctcctgatgctgctcctgttttctttgccttgttgtctgctaacctctgttctgtccatagaccactgtctgatctcccactagtgatgcagcctcaatttcttccactctttcaggtgtgagaaccctgctctctctatggctgctctttggagtcttcattattcctgtctccagtgctcacatttctggtatttagggaggcacttctatctcaagcccagctttttatagagagtgtctcatggcaatgctgcttggacccctggtgatacaggatgctgatggatgcccagaaaagtgtgaaaagttctgtgcatcctcaggagagcaaatttccatctagggccagaggatctggaaaatgttagtaaaacacctatttgtagccctctttcctgcctcagtctccagagcatcatttgagatgtgctgcagactcccctctttcctcagtatttgttcaggagctgcctgagcgctctggctcctgttcttccatatgtacctttgcaaggcaaagatcctatctagggaccagatttcagtaaaatgagacaacttggtttatcatagaaacagaaaatagaccagtggttaccagggtctggaggagggagttagtatttaataggtacagagtttcagcatgggatggtgaaaatgttctggagatggatagtggatcaccactaccacagcacaacaggataaatgtagttaattaccactgaactatactttaaaatggttaaaatggtaaatttgatgttatgtatattttgctacaatttttaaaaacatgaataaaaaactctacttggtttaaagagaagtgaagattacagaaatgtcttaggaaaaacaacactgcctgctcatagctatagctcggtccactgcctgttatgcagaatttctgtaactcagagagggcaggcctgaggagaacatttttgaaaagaattggtattctttgtatcttctagtttgatttaagagtaaactgtgttgtaatcttaagtattatttttctttattgatcaatgatttttagaacaattactacatttcttggtcatatggcattgttaataatcactctaatgagtaaatgccaattgctatgcatgactactgataaaaattaacaatttagaagaagccatcttattttagtagcatgaattatttgctaaaaggaaattgacttcaaatcatattatttgtagaaagctgacagttgaatacaaagacacaatagcttatgcttttaaccaaatactaatagtcgaaacctgaccatgctttcagcacagacagatccgtgatctggggtgtagaggtgggtttcaggtataacagtacaagtagtaaggagttttacattggaacaaagtctgtgcttttaaccacagacaagggttcaagacagacaaatgaggaaaaaaatagggaaaattttgaaccaggagtccactctctattctgacactaggcaaccttgtagcttggaagtatttctcaggagagactcttttaaagttaatattgaccatagaagcaagactatttggaactatcatcaggcactaagaacttctgaagattcatttccctgaaacagtctggatgggccactccagccccagttatataatacctcgatgagcagcagctcaatacaacatgttgtgaggttaatttaatacatgatgcttgtcccagaaccaatgctccttctactatactgctctgcctgcgtggagtcttaaatgtttagagaagcatgaaacactgtatcattttcaatcatgatgaaaatgtaatcttaatgcctattgtatatgtatatatacttaaacacacagcttctttgccaattctttttcctaaatcacatttttagtggagtaaggaatagttataaaatagaaatgttatgtagcttagaattttgtaactcattaaatttgagttcctctggtgtggcaggtatcttgctaagttgtaggagacactttagagatagattttctcacacaatttgagaatatgagatctggaagccccttaatatataaaagctcatctcattttgtatgttaggaaacaactcagtctacagtgaatcattctgagtcccagtggaaacgggtgatagtcaaactaggtaatttgaggagagtttagtacaggaacatataacaaagatatggtcaggattcaaggaaaggatcaaaggatagtgcaatactccagggctagtaatagtagggagccattgctatccacaggcctgaaagaacccaaaaaaaagagctgtggcttttagtagagggacacatgcaatggggtgacttagcgggaagaaagttggaggaataaatgctataacttcactcatctgccaccctccaatatccctctagggcctccttttggttgaactcaacagaatccaaatgcaaaggaatcccttattatagtccatgtaggtcagcctcacagagcccaaagctgggaagagagtggaggagagtagatttgcaatggtaaatggaacttccatagttccctactgaaagacttaaaatgcaaatgttaggacatggtttcagtattcatcagatgttggaagagagtctttgactctaaagggcagcacatataaatgctgtgttatttgagtacaggatattttaagtttctaatttgaaagagaaaatattgttttacaatcatagaattataaactgaaatgccgagaacctgagcagcctgcagatactcacacacaaaatacattggcccattgctcccaacagctcaccaggactcaccaggggctctgctccttctttcaagaactatgagaaggctctagggagtgtctcacatgtgtttaaaaacaagtctgcacccaatctccaagtcattttctcatatatcctgtgtcttgctcaactgctgtgctctggggaaaaaaaaaaaaatctcctcgtgtaactctcttcatgccaacagaagcctggaagtcttctgcccataccaacataagtacagctagcagacagcatgtatgcagttctgctctctaaacacatgcatggccatgtgtttaaggatcaaggccttgtcctgaaggtgtccagctatacctgaggaaggccaggaagggaagtgtgcctaatcctggggtttggagcaaggacaaacatcccaatattgcaccatgccttgtgtaggaaggtgaaggtcaaatagaagggagaggcaagactgagtgtggctttccaatcaatcaaaaaactcacttcttggaatggagaagtgaggggtgagagaagtgagcaggagcatttagggaaaagtcacttctcatggaaggcaaaaatgggaagaaactttcccacattatatattgctttatgagatttttctaaatgctcattcacaaaggtgattataagcagccttttggtcttgttccacagggtagatgagaggttaaaacatgaatttgatcaaagcaagacaagatctggccaaggaaatgacatccactgaagaagtgtggaaaagggtcctgtgggaagtgtaaagatttgagccaatacagtagtgccaagcttaaaaagaatttcagccaacactatgaaagcactgtgacaggttttatacagatgcaagtgcatagccaggctaggaggaatctcttcccccattgtaaaggtgagaaatggcccaggagagggtgcaggcggcccaaagtctcacagcaggccacaaagctggtctccatttcctgaatcccattcccctccaactccacacagccctacagggcaggttgggatcccacttcctgtggacacaccagagggttgttgacctctttggcctgtccccagtccctacatgtttttgagtttcgtttcacagttcttttcagcaaaaagtctcaatggtctaaaactctgcacatcagattttctgtaatttcacaagaatcctagcacatctgagtgtttccatttacactgcacaggccagaatccaatggtgtagaaaacattgtagattttgcaagcacttccaattatgtgggtgtaaaatatttttaagtagattttcccccaattaaataatttctggagcaatcgagtaaaaagaaagcagaaacccagtagcaaacctaataatgattcctgaaccttcctgttaggcagcaagtggggactcaggtgcaacagggttatggacacaagaacttaaatctggctcttagggtatatggctccaggctgtcagtgtctagcttcagcacccctgccccatccgggcaatgcaggggtggtgatgccagtgtgaagaggaactggtcacgctgatgagacagcactttgcaaatagaaggtataacagaaagtgttctctcaatgctaattttaggccagctccttagttaacataggcagaatcatctgggcagccttctgaggaaggaatcagagagccagaaacagtcatatttcagatgttcttccctctgtgtcagtcacaaaaaaaaattgcatttaatgccatttgccaatttccatgttccaattcattttactagccctcaaacttcttatatttaaggcagcagagtgctctgtttacctggctcagtgtcttaaaaatggtatggccctgcagacccaagttaatgctccttaatccttgcaattttcaccatgaatcagagctaagagagccacatacatgtctgctgcaagaatgaaaagcaggaatggccctaagttttagccttcagttaattagtactcactgacttatggtcactaatgagaagtattatagtggttttcgtcttagatacagacattgttgtgtactgcaagtcatatggcagtttcagaagaaccacataatatgagagctatgcccaaacctgttgtgatagaggaagatcactgaggggcagtgacccaaggtcacaaaatataaatgatggcaaagctggtcttaggtcacttggaatatacaagctgtttcccagggacaccatgtaaagctcagcaagttgtgccctgtgcaacttgcatggccatagaaagaagccctcactttctctttctcctgctgaagtcttttggccccatgacagatgacctgggttttatatttgtataagagaagtagtaataagtaggatttggctcactcctcatctatggtgtctaagtctatttgggctactataacagaatgcaatggactagatggcttataaacagtagaaaattatttctcacagttctggagactggaaaattcaaaaccaaggcaccagcatattttctgtgtcctcatatggtggaaggagtgagggaactctcttaagtctcttttataaggatgcttatcccattcatgagggcttcaccttcattacttaatcatctcccaaaggctccacctcctaataccattatattggatgttgggatctcaacatatgaatttgggggggacacaagcattaaatctatatcattccactgctagccacccaaaatctatgtccttcttaactgcaaactacattcattacatccctaaagccccaaaagttttacctcattccagcattaactctaaagtctaaaatccagtctcatctaaatattatctaaattaaatatggatgagacttaaaatatgatttatcctgaggcaaattgctcttccagctgtgaacctgtgaaaccaaacaagttatgtgcttccaaatacaatggtgaaaaggcataggatggacatttccattccaaaatggagaaacagaaaagaagaaagaggtaacaggtcctgggtaagtccaaagtataaggcaaactccatgaggtcctaaggctcaaaaataatcctctttggcttaatattctgccccccaggctcactgggactgagggcctgcctggggctgtggctctgccccagctgctttgccacatggcccacacacccacacatctgggcagccctttccccatggttctcagttcagtggggccatttggcctattgaaaggaagacaattgccatcccttttgaaaccaaggaggcagccctgatgatctgtgagtcttcttcaggattcttgataaatagtgaatgttctcagctgaatagcattgtggtcccatcctgtaaaatccaaatctgacagccttccttcgttccttctcttttccttcccctttggttcaaattggcagtttctctgctggggtggatgattaagtttgtggttcatacctatactaatctcttaaatagtcagttggccacactgttagtgttctcttccaaacgtgggttctcattttttgcaatgtggatagactgagaattttctaaatctacaagttctcattctgttttgcttaacaattctgtctttaagtcattctgtctttcattttactataagcagctaggaggagccaagctgcaccttcaaaactttggttagaaatagcttcagctaaatatcccgtttcattgctcccaactaaatatcctgtttcattgctcccaagttctaccttacacaaaacagcagaacataaacacaattcagcaaagttatttgcctttttataacaaggatcacctttcttccagtttctaataatatgttcttcattcctctctgagactttatcagaatggtctttactgttcatatactaccaacattctggtcatgggcacataagtattctgcaagaagcttgaggctttctctacagctctcctcttttctttctgagcctgcaccagaattgctcttaatggtccattcatggcagtgtaagctttttcaagcatgcacctcaaaattcttccagtttctacccattacataatttcaaaactgctttcatattttaggtatttatttgtttcaacagcacccccatttcttggtatcaatttctgtgtcttatgaaaaggcctctctgaactccatgtattggtttatgtatgcctgacttctaggctatagtagtactctataaattgcaactagcactcttgaaattttcttgattagtagttccttgagggcaaggattcgttttatttattttatatccctaattcaatacttagcaaatatcaggtactcaataggagctccttctcttgtcctcagtaattcagttcaataagcaccttttgagcacctgacattggtttgatgccaggccattttttaaagctgcaggaagcctcagtatttagtaaccaaggtgattatttatttgcaataagtctgatatggagcagccaaatcctgagatacctcatgaaaaaaacagaaacaataacttacattcagtgagcacttctaccttcctaaatattcactaaacccctaagagataggtactattattatcccaatgttactttgacaagacaagatacagaaaatttatctatggttacacaatgttaaaatgcatatcttgactgtataattctataacctgtgtttacagctactgtgctatggtgcctgaagtataattaaataacaatgttttggcaatattgcatttcccagacaacttaagttcaatcatttaaacaaaaagtatctgatttaaactagaatctattacatgcttcttattcaagatgttgcaggatcaccactcaggatgccctctggcctgttgaggtgtgtatggatctaagttctccttcactggataattccagaatgttatgatgcttgaactcaacaatttctcctccttcctctcctcttcttcctccttcttcttcctgtgtctctttctttttatttaaatatactttaatttttagagaagttttagtttcacaggaatattatctttttaaattgcaaaagagagacacattcattttataaagtttaaaaatacagaaaataagatattaaataaaggctttgtatttacgtgaaagggatattgatgaggtaattgtggcatgaattgttctggattatcagtaagatttcattgtgttcattcttaatacaatgtttcctcattggttcagcaaaatctgaaacacttaacatcagagctgtctggtcccacctgtttccactctctaattacattaccaccttccctacaaagcaccattgatatcctcaagttctccatgggctgattttctaactaaatttcccagtattatatttattagccctccccctgacacacacacaatcatctgaggatcaggaaaatgtcttgtattctgaaccacggtgtgtgtgtgtgtgtgtgtgtgtgtgagagagagagagagacagagagagagagagagagagagagatcagatttattcagagttgagatgcttgctaaaaatggagactctggacctcacccaagacatattaaataagaatatctaagattgaagtcagagattctgcctaccaaaatatgttttatttttactttccatcaggaaattgacaagcatatttaaaagtagagaggttaatataataaactccatgtactcaaaactcagtttcaacaattatcaattcatagtcaatgttattttacctataatgtgaagcaaattgtgacatatcatttgactatttctgtatgtatttagaacacataaccacaatacaattatcatacctaaaataattaacaataatctctaatattattacatttttagttcaaaacatttcttgttttgtcaatgtgtcttagttgtatggtgttttaaacccaatcacgtagctggtccaggccggactggcccctctctaggcctgttgctcagctcgcatgctgggacttccttccaccagtcttccaacttcagtacagtttctcatgtacactgtgttttctgcctcattttaatctcctacattcatcctcaagtaacttgctatgataaatacattgaaaataatttttctgacttgttttgaaagatgactttttcagccctcatgctttattgatatcatgtttgggtatagaattctagtttgaatgtaattttttctcagaagtttgcaggcattattcaattatctatggtttctggtgaaaattctgatgccactatggttctaatttctttgttattttttcaaattcattttgtctcttaagttttgtgactttctctaatcttcatgttttgaaatttcacaataatgcaattaaggtagtgatattttattatagatgctcagcggacccctatcaagttgtccttcggttctaggggactttgtttttttctttgatgactctcaccttcattctctcattctctctgtcctcacttctggaaaatttaaatattagacctcctggataaatactctacatatcatatctttcatttaaatttcccaagtctctgttttgtttggttttgtttttctcggtctacgttcaggtacctgttccttgactttgctttctatttaatttttcttttatttcaccaatcacattattttacttctagatcagattggatctcaagggtgtctttttctggttactgctgcagtcacaattctcacccttggttgctgttttataaatctcggtacatgaattaatttgcctcttgcattactgtaattcctttcatgtcaggggccatttattctgatggctcagcttggttacctcttttgaggtgttgatttgcccatttcttccatggtttttctttttttgtctgtttatgtgttcttcctggcccttcacagtttaggaagacaaccaatttttctcatccatgtgagtatgtgggcttaaattttttacttgttggccagtaatcaccgtcactctaatacaggtccactttttttttaatgcttgcaggaatcctctagtattacaggtgtccagctggaatgtctgctgggtctaaggtgtcatgggtgtcttctatctggtgtgctagggatgttgctacaatgcatcacgtcttatggctagagctaatagccagtagaagaggtttctgacaaacaggcgtgattacagggcatctatgccacatcttccctgggaagaatacactccatgcagctctgggtatagttttatgcacggtcacccccaaaacagcaatacttctagggatttggatcagaactggtttgccatttgcctcttttcttccttgagggactatctggctattacctcaactcttggataaaagcactaattatgctattcctgttctttagaaaaattatgtcacgactatttttaatgtcatatatttttcaatttttaaaatgagatataccataaatgacaataatatatctcatgaacacatgtaaaaattaataataaaacaaatggtcatgtttctaccacctaacttaagaaataacatcttgtgattctaagctgatgctccctctccatttttggaggtcatgggtctgaggtgggaagtatggccttagtgattccaaagtagctttctagcacctctttctgaaaaaaacaagagaaaggtagaaatgtactatctagaaggcatactcagctatttctaaacagaagtctagacaattatgcttggtgtctggtgtggctgtgtaggtcactattggtgtttcctataggcatttctctctggaccactgctaactcacacagcacctttgtgtaaatcagaaaaaaagccactcctgccatttgctacaatttaaaaaataacaatatgcacaacaatctgtaatgactatgactgtaactggtgccccctagagtttacaggccacaacccgcacaaccataattcaaggtagacgtagcagatagtacaggcctcctcagatgggcttcatcacttactgaatgcctattgtgtgccaggaactcttttagattcttggcagtcagtgttgagatggacaagatctctgctcttctggatcccccacgactggacttctgagcaggctgttttgtgagtgcatgagctgtagtcaactaacaggctggagttgttcttaaactgggtcaggggtcctatggttactagttaaagtgaggcagaacttcaatttacttagcatgctatctatgccaagtgaatcctgagaggtcacgttgtactaagctgatgagttcagaggtcacatggggttcttaagtttatgatgaccctacatcctaattttccctggacaatcctaggttaagtatcttatccccatgtaattattaatataaccccttttctctcctaaaagtgtcctagctttggacagtaaattatatgatcacacaaattacctttttttttttttctgtgccaacatcccttcaaaatcctagtgacttaatacactaaatatttagtttttgctaatggatctgtggatcagctgtagctttgccccaggttgtcagtcaagtttaagtttactccttattttggactttgggctaatgccacaagtcttctcattatggcagtcaggctggaagatcagctcttatctgagagctcttttctcatgcagaatgtgggagcacaagggacctttgcttcaaggtggcatgggccatattcactcgtatttcattggccagagcaagtcatatgcccaagaccaacactggggattgggatttatgcttctcccttggagaggagccctgtgatagggcagagtgactaataacacagttatctcatcacattcctaaatcctacggcctcccagtgtgccccttctccagcctttgctggtggtggtctcctagcagtgtctgtgtcaggacagagctgaagtgattaacagaatgtagagaagaagttttgtctccatttagactacagaatgtattaagagatttcactgctatgtggagcctattttgtgttggagagggcggggattgatgtttgcagcctgattacctgggacagggtttcctccttcgtggtcccccagcactatcacccatcacagaagtctgcaccagcatattgtctactctcctgtgtgagcggtcagaaccaggtggactccggggtcaatccatgccctccccacctcatgttgggctctttgaggtatagttcctagccccttttactttgaccccactgactccactccctatcccccatccctgcctgttgctctgcacctgggatttttaatttttattttctctcagtctcccttcatttgcctgtgttaaatgttcaacagtaattggcttttcttttaaaacaattccagatattcctcaaagttcctggttaactgatgaattgatgatgccctttcttattttccattgcttatcccatttctgcgggatttgaggagacaaaagtgaaaaagatttgcagagttacccatattgaaacttcaaccccagtattttcaaacagagatataatattgtttcagtagaaggtgaagattgattgggcggcaaagaggaagtatgttaaatccatcaacagtcctggcagctggctttcttttaagagcaatttttgataaacagttttatcaattcacaagaatgaccaagtaccttcagagtcatattaaaaagcaggtgggtggtagttgttcagcttgactcagtaggtaagtgacttgcaggaggggttcccatgcatgcttcagcagaaatacagctttgtcacagatcatagtatgttggcagtgctgtgcatagttgaaattgtgagtactatttagaactcacaattagtcatttactaatttctaattttctccttcgttagaatatgaatctgtgaagacatggcgtgcgcctatcatgttcctcattatatctctagagcttagcgtagcacttggcatgtagtaggcattcagaaaactttggttgaagcaatgcaaatattaatgatgggcagtagaggcaaaccctggggagaatccttggggctccagagtgtaatgaagcactgtaatgacaggcagggttgtcctttaaaataaggattttacagccaccataatgccagaaatgcattcagattgatgctcagcctccttggttctactgtagcctggggcagaagcctggagggggtgaaatgttttgaaccttaggggcatagtcactggatactgaactgccaagacttgctgatgccatggggctgtggtccatgatccatgtagcagatgctgtcattacctgccatgtccccttaccacttcattgtgtgcctgttgacctccagtgcagcctctgcattgatttcagtgtgggattttcctggccactgaagcttactttgttcatctgggctgcaggtttcaaatgatgggaatttaatgccctttgagaaatgccctctaattaataactaaagagagctaatgtgtaataccttggatcccttgccacttaggtggggtatatctgaggtgtattaagcctccatagcaggtttaacctttactccctcactgtaggaactggcttgataatgtaccttttattggcttccttttctggatcacttctcctgtgtttccttctccttctaaataatgcttttccctttaatacttgttttagggtatgctactggggaaacccaaactacaatattctatcctgcgtcctgaggacttatcactgagtgggggttgttcttgaagctgcaaaattcacagaagatttgagcttcattttgcttagaaccttaaaagttaataggaaaaatagaaccaaaaaagcactctagtttctcgtattttaaaaagttatgacttacacaattccccaattatattatacagctctctgagatgacagaataattgttaaggacatttgaaactgccctgctcaaaaaacattaatgattggtgctgcctgtaggatagagtctcatttaacttgaagggcattctagtccccatgaatatatccattttcttgccatagcaggctgtttattgtttctaaacatggcttgcatgctatggtacctcctctgtgtttctgctcactggtcctctggtttgtgtatgaattctcattgtcaccgtcccagaattaagtaacccagccatgcgccccagcatggccttccgcagtcggctcccaagggatgagtggatgagagggtcattctgcccacgctgtgcaatgggtgggcttgaggggaatgaccacactgacctttgatctttgcttctttgcagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggtcagtaatgccttctcctttctgaatgcaaggaaggaccaccccattcccctctctggcaacaatagcactgataggtcaaggagcctgtaaccttttagatttctgttctgtatcagagacatgaatatgggaaaactccatgcttcctacgccctccttggtctctacttagttcataaaaataatagttaacatcattaagacagcatgtgtgaagtactctataagaactttatattcatattttattatagctcacaacttagcatgaaatgtatactattatcattcttattttacagcagaagaaacttaagtcaaggcgattaaattttttaaaaagctgtatatgtaaatacccaggtcaggatttgaaccctggctcaaccaacacaagaatctgagctcttaaccacccttccctgctgccctcctactgctttagaatttattccctgtgcatctgacctatcctaacagtcacacacaggctctcttcagactccgccgtgtggctggaggtctttgtccgtctccagcctttggaaggcttacagagtaccgatacctaggtcactctcttttcattgtctggatgctttatgctcttcagcagtagagaaataatataatgcagtgaaaaaagatgcggtctctcaagtcaaatgaattggctttacttacatgtgtgacattgaacaaattacttaaactccgtatctgtccatttcctcttcttcaaaagaggagtagatagtactgatttgtaggtggttttaagaatgaaatgatgacatgtgcttgcacaggtctggcacctggtaaatgttccaaaatgtgagctgccattttgctgttagtattgctattatggcctctcccaaggctcagatgttgcacaaaagtgtgtttgaggctaagcagccagttctaaatcactggatataaaaactcatttttgataagatatttcaggaaaagagactcaggaagcagctttctttagaatgaaaatattggcctgagtgatggccagagaaatagcatgtgctgttatttggaaggtataaacacaatttggaggtattttttaaaaatatttgctgtttgttctccagaaacagaaataagactttaccctttttatgttaatcgagtttatcctagaggctccactcattctcattaagtgggatggaatatgccagtttctaatttgattgtttcagaaacttattttagcatcattttcaattctgaatcaaagagccaaatctaaaatatgcctctgtgaggagatgggtagttgtctgccgtttgatttagaagaaatcctcagattttatcactaggatttatcttcagatttaaaacttaaatataactagagctctatttgatgctgtcatagagttcatgcaatgtgcagacttataataaaatcctttcagtatttcaatagctaaagccttttagatagagtctccattgaaatttccattgaaattgccccctatttggttctactctgcatgtaacttttctggtctgagttcctccaatatatggtggtagtactgtgatcttgctagatttgatctggggactctgccataattctaacaaactgatagcaatgatgccactataattatcacaatatttatactgggaaagtatataaatatactgcatagcaataaggatttgcttaaaaaataactgttatcactactgatttgtagaaattgggtagaaggaaaaaaattaaaagggagagtgaaggaattatccctgtaaaatgcactttgtgttcagatttattttagttttgaaggcatgcaattacattatcttttctgatggcaaaaatcaagtttagcaatatctgaactactataagaaaactactcttttctagctgcatttgacctaatactgacaatttgcatttttatgcatttaaaacattcatacctaagttactactgacctagttttatggggtctgtctggaaatatatatccttgtctcaggatctcaccacaataagagcagtacatggtcttctaattctttgaggattgtgttgcatcatgagaaaatgcacacacacatacacactttttgctaacaaaaaggaaaaagagaatgaaatttcctttatgcctcaaagcatttttaacattcttctttaacattttcgatacccatatttggggaggggaaaggtaagctttgctgagaaagctctaaacagtctgcttttccagttactgtttcttctcttttctttctcattatgttctttactttctccctgccgacaccgtcttactgcttccatcctgcagccattatcaccgtctcaggacagccatgatcacagtctcagggttcccagtgcacgaaagacacagcctccatttaaaggtgtcttcaggatccttgtgattggcacagtttctgtcacaccattgacatcaaaaatctcaacctcacctggcctcttcggcttggatgtgttcttggatatgtttggctgacacagtgcctttttgaaatgtcctaaagatgggctttgttttatcttctaagaatgtttctggtcagaatgactttctgttgttctttcaagatcaagcatgttcggtgtctagtttcttcagtgactattagtaccatccaaaattcctgtcaattctttttgatttgaatgaagtcccttttgtacagtgactcaatatgctggaaatgtggatgtttcaattttctcagaattttttaattccagagctttataaagttctctactccaaatgtatgaaaatccctggatccccaaaatagaaggaaccttgaaaggccatctaatccatttcctgattcatgtcctaagatgaaagttcatcctatttttctcaagccttctcaaatgtcttatgtaacacttcagtttttcaaaaatttcaattaccacaccacaaaccccttatcaggtctattaaggccctgcattttaatactgccacagtctgcttccaacagcctcaccttatggccaaggccaccatgttgcagaaccctaggggactattttaacatgaactcaataggagactgcctggaagaagcttgttgtactgcagctgcactagcctctctcttagttccttcagcatcccaagccccttcctgccttgaggtcttcacacgttgttccctcagccaggaatgcttttcctttttttgtccttcttgggacctttacttcccttacaccctagctgaaacatcaccttctcagaaagttctccccggccactccatctgaagtctgtgttctgtcccccactccttcccactttaattctccctcgcattgccttgttttcatgccttcacaggattaaattattttaagtgattctttattgcttgtactcccctctagactgagttctgtgagctcagagaccacatctgttttgtttcttcctgtctatccagcccctagcaccacctggcacatggaggacttttttccatgaatgactgacagaatacattggtcaatatcaggccacttttctcatgctcttctgacaagaatgacaaagggccagaagtataaactgagcagagcctgtaataatggtgtgaggctggcggaaggccatttgtcccaggtctcacattcattaagagccccacattaggtttttgaccttacctctgaattaagcaatccgtagagttacagaaatatgctgacagaattgaaagaggaagataaccatcacactctaaatttaggtcccatgactggccacaactcaagtaaatagtacacaaaaattgaatgtaattatactatgagtagcacatttctattaagttatatttttgtgtggtgagaacattggttcaatgtaaacatctaaaacataatttttgaattatagttatttcttcagatttaaattaactgcttcaaaagtggaagttgcctagacctatctcaacttccacgagaccccgaaatgatatgtaaatgagtgttttctctactgggattaaattatcagaaactattatatccatagcatttctatatttactctagacacagatatcaagcatttgctatggcaaaattcaatattaggtggtggcaataaagagagaaaaaatatataaccatgcccacaaaagacccacagcaagagcaccaattatacacactgaagtgctcaatttgttctttagaagattaatctggaaagaatgcataagatgcatgggacagtggtgaagattggatgtatacaggggcctgtctgagggcctgaactcagctaggatcaatgggaatgaaaagagacataagacgtgagctactgtagagaaagttttggtgaacaaaggctcatcttagttatggaggataaagtattcaaggtttcaaatccgtttaactttggagggagtgggaggaagcaggtcttgcctcagtgtatccacctacccttgacaacacacctccactggccccaaggcctgatgcctgtctcgtcattatctcacttatgctggaaacccttgaatcttcagcccaagaaagcctcagattttcacttcctcctgcccttgtagtctactaactgtgtctgtccctatccaggatttccccttcttctgtgtctgcctgtggttcaggaaaacctaactctctcttcttcatcaccaggggagttttgaagaaaaacatcctgtctccaccatttccataattccctgccttgacttgaacataggaaagaaaccagtaacatttctgaaaccacaatttgcttctctcttttttctccttggatcctgaagccttgtagacactggtgcccgagaaccagggaaaggacaggtcaggtttcacctctgaggtgggccactgcagtgaaggaacatatattagggtgcacttgttcatggcttcacatgaaagcccgcgatggaaggggtgttggggatatgagtgctggcttgtacagagcctggactcagagatgcagtgggtgtatatgagggactctagaaaaagctgctggggcagaagagctgaaagtcccattctgctagagaggtaggaccaagatgcaaatggatttaatgtccttattgacgtctacagcatccgcttgaggtggctaagaatgaggccaagttaagtaggcaagcccagctcaagtatcatctccttcataaaagtttcctcagccagaggcctttctccctctcatcttctggtgggggaaccatctcatcacccgcctggacagccattttcttcaagatggtgactacattttgcctctctgcaccttccaccccatttgacactgctttgcaaattcgaatttgttgaattgccattacgtcctgtctcttaagatctgatcgacatagttggcttttcgggtgatagtttagggactaacctagagctgggactagttaattcacatctgaggaaaggaaaggaggagaaaaccttgtacctctgggattctggcctttcctgaactatggctgcaactcagcacaagactcaggtttctccaggcgtgaaagtatgtttttgagtttgttttgggaaatctactttgcacattttgttaattatctttgaactcaagctttccacaggttcaactgctattcttcccacttaggtctggggtagccaagtctaatctttattttctctttgttgtttcttccatgagaggaaaacagcttttgcccacccagagagagaatgggaggtggatgaagctgagagttccaaccccagcagccagcttctctacgacagcattagggtgtggcttattagtagaggagatcatctctcaactttccttctgacccactgtcgttggggtccactttttttcattcactgtgcacattaagtcctgagaacaccaaaatacgggactccccagacctactcagaggactgtctgcttcagtcacagatctctctttgccaaattcctacactccctcaatgtcattgtccttgtcagtcagtggctttgaaattctagacccttgccctgggagcctcgcatttactgcactcaaaaccacctccattaaccatttagagccacctcacctggggtgggggaggctcaggtaatggctctatattccgtatctttcctacctcttgctttgggcttgcgttttcttcccacctctgtttgagtagcctatgagaactatagaatattgattttccatttcctccaccccctcttctcctttacgcccctggggcagtctccctgctccacttccttattttcagcccccagacctccagaggttatacagggaggttatgagttaccctggttctctggctcttctaagcttctctcttcttccgtgcctctccccgaactccagtaaactctaactctcttctgaatggaaattgaaagagattgaaagggagccccaggagtgagaacctgtcatgcccagttacagtcttcgctgtctgctttaagccactaccttacagttagattcaactgatttcccaagagtaagtgtgattctgaatggaggggaaagtgttgggaatgaaattatcatgtaaaatgtttcagtagataatagtattcatatctgtgactggttttttgtttgcttgtttggtttttggtttttgagtttttttgagatggagtctttctctgttgcccagactggagtgtagtggcgtgatctccactcactgcaacctctgccacctgggtttaagcgattctcctgcctcagcctcccaagtagctgggactacaggtgtgtgccactatgcctggctaatttttgtatctctagtagagacagggttttactatgttggccaggctggtctcgaactcctgacctcaagtgatccacccaccttggcctcccaaaatgctgagattacaggtgtgagccattgtgcctagcccataactgtgattttttttttttttttttttgagacggagtctcaccctgtcgcccaggctggagtacagtggcacaatctctactcactgcaagctccggctcccaggttcacgctgttctcctgcctcagcctcccaagtagctgggactacaggtgcctgccaccacgcctggctacttttttgtatttttagcagagatggggtttcactgtgttagccaggatggtgtcgatctcctgacctcgtgatccgcccaccttggcttcccaaagtgctgggattacaggcatgagccactgcacccggcttgtgattggtttttaagaggtcagctgtattgggaatttttggagggattcctgtgcaattgggttctcagggaatgggatctttcttcagtctttgaactacatcaacaacccccgcctccctgctggcaatccactttggttaggaagagctgagcatgtgggacaatttatcttcagatttcatgtctaagaaaatgtacatgtagaacagaatatgtcacactactaagtagccaaatccatgtattttaaattaaaattaaaactatggtggccaggcacagtggctaacgcctgtaatcccagcactttgggaggctaagttgggtggatcacctgaggttgggagttcgagaccagcctgaccaacatggagaaaccctgtctctactaaaaatacaaaattagccaggtgtggtggcgcatgcctgtaatcccagctatttgggaggctgaggtaggagaattgcttcaacccgggaggtggaggttgcagggagccgagatcgcgccattgcacttcagccccagttgacaacagtgacacttcatctaaaaaactaaaaaacaaacaaacaaaaagcaaaaccactatggtagatttagtcctacagacaagggtgaagacaaaatgttgctgtgatgaatcgaatgccagtactaagaaaattcaaagggaaattgtaatgcacagtctgcccagcaaccatctgcggagcagcagagtgacagggcctagggctgacatgagattattgtctgggactggattgtgtagacacagaattgttggtccaccacagactcatctggaggaggagcatccagtggatattgaggatgcacttttatcatgtaaacagcaccacttactagacagtacccagaagggtgggaactgatgcaggacccaattatggacattttttgaagaaaaaatgtttcttttgtaaagaaaactcaatagcagagggaaatagggctggcaccagcctattctgacctctgcatatggcaggttactttctgctgcctcccagtcctttctgcccacagagtccagtaaagtgagactcaagctctattctagcactacattggttccacttctggacaagggagtgatctggctgcactagctcagaaagccagttttagatgcttaacagcaactcctgccttccctcccccgcccacccacatcataaaatacagagaaaccttaagagtgtggatttctctaaaagagattaaaatctcccttcagcaactctcagatcacaaagtttttgtgcatgtgggaatgtatgtgactgggctatgtctgcttgctatggactgtgttagatgtgacaggtaccagtgacagctctgtgacggtactcttgtcataccaggtgggtgattagtgattaggaggctattttaggataaagaggaatgctcagcataacaatatctgtggtgacaagggagaatactttcaaatgtgtctgggggtcccttaattccatttttacgtctttatttcattgtctgaagaaaggaagagaagggcaaattcaaatgtttactctgcctctccaactgtttaccaatccctaagagacatcccagctgttctctttcaccttctagtaaagaggctattttaattaaggttgttgagcgaatgcatacaatacaatataatgactctaaactctgagctaaaaacaacaaaagtaaccttaaaaacaaccttgtatgtgataactacttctctcaacttgggaagacacacacagatcagacaggctttaaagagaattttagggaaacttctaacccaaaccaatacacttacagggtgaagaagactatactacagttgcaaatatttagtttggagtatcagtatccagccatctccagttgaatccctacatgcatttatagtagctcatctttaatttttgagccattagtgtttatttcagaaataaaacctgtcctcttgatcactaatcacccatgtgtacagcaaaagcacaatcccaattatgtcacttctacctgtcagagccaccacaatccactgcatgcagacacatcccagtcatatacatttttgcatgagcaaaagctgtgttcttgtgatgaaatgatttgatttgaaccagtaagaatttatatccttataaagctataagccagtggcaagaaattctgtgtaatttagagaaagattcattcttcttaaggcaacacttggctatttcaatttcagaattatattatatataaagttgaataattttatttttaaagcagtttgtacaaatctttacattccaccagaggaataagcttctttaatggcatattagacagtttaggaactatattaaacctttaaagctctgaggtcacatgttactaggttcatttcctgataccaagcctcagttgtgagcttcaagccttacggagcagcttactcacactgatgagcattttgaatttaggccacacacacacaaaaaaggcccacagatctaagctcctgacaaaatataacagtctacctacatcccaggcaaaagtttctgagagacccatagctaataaggttataactttgttctgtgttgctcttcattcaaggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgtgagtccagcatttcttcatttttgtggtggggggcatcttggttagcaaggaaacagattacttacacattatcttgaggacaaagtgtaaaattcctgtcaatgtacatgtagcagttatttcagaacctccttgtaccttttcagaaacagggttttaacaatattgattttgaagtttccaagcattattccatgaaaacaatattaaagaataacattctctcttttctactttcagattcttagctagcccctaagagacagcaggtgttatctgtcctccgtaccacattttctttagagctttttcaggttgtttgtgctgaatggaacctggcattctattaactgtagtctgcagctaagagaccattacctgactctgacagcagtaggtacttacctgtcttctgaggttggctcaagagcatttcccatgattggatcctcagcttcaaccctaccagtgggagtggttgagaagagttggcaacacatttttaaatgtaaaactcacaaaatccaagttacaaggagggaagtctgaaaagaaactatagataatggcaaaactaatctatcgacagtcacatccaatttagggctcaggagagaagtcaaaggtgctatgtagtggtaccatacgtctatgtctacattttaaacacaagatttcagaggtgatatttctactccatttatatccttttcattatcctgcagaggtgtgttggcattccagaaatagaaaggaaaattgaacattcttaggtaactctgatattttaaagccacttgtttctttcacctgtccaaattccctgagataactttgttagctcctcttcctggatatgagctattctgaggccagcgtagctctctttctctgccatggcatccaaatggaccaagcaccaccgtctttattcagctcagacactgattcagcttgagtctggagcctatttagtgaaagactaatctctgcctaatgaccaaatacctgcaccagtaccctcttatcctcagccacttttatgaactagggactcacccatgctctgattgccctgtgggacaccttctctccacatgccacagggttccagtgccaactttgtgctgctatccaaataaacaaaatgtagcatgggagtctgctggcctttatcataatcatgaggaaagaaagaaaggagttggagctggataaggtgcagagaatagcagttgatgaaaccaaggtgatttgggatactggggaaggaataggtctctttatcttaaaagataataatacacataaacccaacaatggatgctggggaaagcaaggcttgtctcccaaatcccaactgacaaaatcaggaagcaacatgagaaggtttaaagaaacaaaatgggaaggctgcttatacaaagatacgaatggctcaggcatcaccccccactggggtatttactaagtctccctggttatgggagctgagacactgccagctgcagtgaggtgccttgaacttaagtctcatctcaggtatggtagggaggtgttggtcacaccatctaatgagacatcaatttatactttttgacaaatggattccataaaatagctggagaggttattagaaagttcaacgaggatcttgctgagagttgcctttagagactttgtggtgagagcaacgttgactgcgcagtggctgatacaaatctggataaggctgatgatccctggtgggaacgactcctaggacaggttcctgtggaacaagaatatggagtggcaggtgatggagaccttctggccctgagatcactgccatttcagcattctcttgggagtaagagtttcttttccattgttggaaaatcctggatttccatagggttaaggagaatgtgaaattatttatcagggaggaaaaccaataaagctacaggcttcagatttctcagttgtttcctcaggcaaacaataaatcttctgagcattgatctaagcctttggatggccacgggagagggtaggtcctgtcaatggaattacaggctatttcatagtctgccatattattacattccattttaaaaaatgttatttggggttgtggggtttttttttgtatagagactgaacataaagagctgagatttgccatgattctctttttataatatagaatgtatataatatagtaaatataataaatggattaatgaaggaaaaattaaatgaacaggcctgaacccaccatttagttgaagaatagaacattacttctattgacccttgaattgtcctctattgcattccctctcagtccagtcctgccaagagaaaaccactatctttaattttacttatatcatcatataaaaaatatatatgcatatacatatgacaatatgggtttgggttttgtctattttggcattttattgctcttctttgactagctttttttctttggtcaacattgattatggcatttagtaatagaaataagcagagcagctgtggcttatgtatcttcattgctatataatattccattgtattaatattaatatatgacaaatttgcattcttgtactgatgacattcaggatgttagtttttctgtgattctgaataatatcgcagagattttgtacacatcttttggttcacatatgcaatcatttctctagagtttatccctgatagaggtaaggtatacatgtgttcagcttttctagataatgacagtctttttcagtcatttgcacgtatcacaaattgatccttccactgttgaaatgtgatgatccctagtgttccactttctctccaactcttgcagttgccacactgatcaatgtatgtgtgtgcatgtatgcaaaatgatatattattggcatttcttcagttgtccggtttgaccatctcttgatatgtttattggtcattcatgttttctttcttgtgaaaattcttgttcagcacttattcttttgttttcctttccttgttgattcacataggctttttaagcagttgggatgcaaatcccttgttggttatgtgttttacaaacatcatctctcagtttatggctgtctttgtattcactttatggtgtctttgataaatagaggttatgtttggtgtaataaaatgtatcaggattttctgttgtaaattagcgcatttgtgtcctacttaagaagtacttccttaccctatgtcaggaaagatatttctcctatgctttctattagaagtgttaaggttttgtcttcctcaattatgattttaatccatctagaatggaaatgtttacatagtgttatataggcatcatatatcagtcaacttgggctgccataacaaaataccataaactgggcaacttaaacaatagatatttatttcttagagttctggagcctgggatatccaagaccaagtttcagcagactccattcctggtgaggctctcttcctggctcaccttctcactgtgccctcatgtgacagagagagggagagagctctggttctagtctctcttcctcttcttataaggacactaatcctacaatgggggccccaccctcatgacctcatgtaaacctgattacctcccaaaagcttcatttccaaatactgtcacaatcacactggggattagggtttcaatatataaattgggagggacaaaaacattcagtccataacatatccatatttatttttctatatgggcaaaaaattttctggcatattttcccaataatatgcactgtatgctctgtcctatgtagatttctgtatatgcacaacctgtttctggattctcttttctatccactgggatgtttaactatctctatgaatagcacaatttgcaaattactattgttctatgataagccttaacatctggaagggcaaatcatccagcctacctctatcttagttcaaccttggctggtacttgacttttctcacacattttagaatcacattgccaagttaaacaccctctctggtatttggatttgtatgaagtctattgattaattcatgaaaattttatatcttttgtgatattgagtctttctacacgtgaccatagtatatctctccatttacttattcttttacttatttcttctttaaagttttttattcaaagcctataattttctacgttaagatcttgcatgtctcttgttagatttattgctaggtacattactttttgttcttttaaatgttatcttctctaaaatttcattttctaactattgctagtgtatagttaaaattctttatgttaatatatcttctatttggcagtcttgtagaactcattaatgcctttttttttttatggcattttgctcttgtcacccaggctggagtgcaatggcgcaatcaaggctcactgcaacctctgccttcagggttcaagtgattctcctgcctcggcctcctgagtagctggaattacgggcgcccactaccacgtctggctaatttttgtatttttagtggagacggggtttcaccatgttggccaggctggtctcaaactcctaacctcagtggatctgccggccttggcttcccaaagtgctgggatttcagtcatgagccaccgcgcccagccttagctatgtatattttgtggatatattcatattaagaatgttttactctattcagagttgagtaagcctttttatcacacgtaattgttttatcgtatgctataatccagtgaggttttttttactcctttaatctgctattttggtcaattacattgattgattttctaattttgagccaatcttatattcctagaatgatccacactgatcttgatatagtacattttctttacactgctgagttcagtttgataatatttcatttagcattttatttcttctgtgctcatgagtgatgcatgtaatatgctgtcttgtactgtccttgtctggcttggaatcgaggtaattcttgctttataaagttagtttggggcattattttggatgcctgctatttgttcctgctcagtgtccctgaaggctttggggtttttgtgtatctttcttcaaactggaagaatgcccctagtttctgacttctccttaggttcagacaatgagaaagggaggagagtggggtcaggatattcattcccctatttcttctttttttttttcttttcttctttttcttttttttttttttttttttttgagactgagtcttgctttgtcgcccagggctatttcttgaggtatctgtaggctggcaataactttcaactgaaagccacaactctggaatatgcctttattttgcttttattcttaaaagattgtctgggaataacaatttgggagcacaaaactgagttactttgattttgccattataaaactatcatttcattgtcttctgacctccaattgtttttgagaagttgacatttggtctaatatatattcctttgtataggaataaaaccgtaattaccacagaccccataacactagctcagtggtaatttgggtatgaatgttttaaatgcataacaatgcgaattgtcagtattaagtcaaatgcagctagaaacagtagttttcttatggtagtgcaagtttgtattaatggttagaaactggctgaggggacttttgtttcttttttacacaaagcaagtctaagacaggcatgatgttggggataatatctgtttaataagcaggggagaagttctgtgttgtttatcctttaacgatgtgactctcaggctctgcagtcctctgaatgccagaagctaagccaccagagactcacatttacctccattcaagctccagctgcagagtttacttacctctgtggattaatgctttcttgttgtttctgtccactgaaaaattctctttctggtccgtcagctctgctacacattaagaagaattttttaatctagtatttttacctgaaggagtttctgtgagtattcaaacctattgcaagaaacactgctatatggctcaaagcttatttttaaaaagccattttgcttatactaactgagtagtaatctgtgtattatatatttgtctttcaattgagtagaactttagaggtccttcaatctagcagataaagctgagatgaatggccattaggacattcagctgaggttacatagctgaataatagccaaatcaaaattaagaccaagttttttaaataatcatttcagtctgtgcaggaaaaggtggctcaaaatgatcatatacactggtttacttctccttcccctctttacctggctaactcccactaagctcttaaatcccagcttatgtgccatttcctcagagaactctttttctgagccctggactagtgtaggtttttctggcatttgtttccatgacactctgtatttctatcattactcatgcttcttttgtgtatttgttcaattttctttctataagtgcaaaacccacatttggtttgcttcctgctgggtgctcaacctctagaatggtgtctgaaagttagatatttaataagcacttgctgcataaagtgaaactccttatgagggactaatttgttgagtctctagggactgcttgagttggaggctgttatgcagaactgaactcataaactaatcttttttaaaaaattctttgtttctccaaggagagtgtgagttttataaatgttggcactcaaataaaaattaatcctcatgctttcctatgaaagaacaaaacggcaattattgagtgtaaaaatgatggtgtaattaaacctctcaactactgaagccagatcaataatagtacaatacatctttgtgaggattttatcagtcagcaagagagaagacagcatcaagggggaaggtcaaaatttcggagactatgagtccagtgttctgggttaatgttgtctgtcaggacgatcctcttggcatttttagtataccccacttactagtggctttctgaaaaagtaggcattaagcacttcaggaatctctttcttggtggttggcttagaaactggttcggagactgtctctgggagctatgatcacctcagttagactctgatttggagaagatgccacagttctcatgtaatgacagtagaagtaatgaatttccctctatgccaatacagattccagttcagaagaggcaaggacacagtttacaacagcatagactttcttttaatgttaagaacttaaaactcttatttcagcaaggtttgttattttgtagtgactgatttggagactttcctgttctgtctcccaaaggcctgaggccactcgcagacctgatggaggtggacacctggaaccacccaggcagggggaatataagtattcagggaagtccagagtgcttgctcttcatagtcgaatacaaatggggcaggcaggctctgtgattgaagatatttattaatttgaatcccttttcatttcattgtaccataagtcatatgtgattattatattgatgcaacacaagtgagccccaaaactggggcttagcccaggagagttcttggcttcacccaggaaataattcaagggcaactcagtaatgtttgacagcagtcttttattgaacagtactgctccatgcagagcaggggtaactcataggcagtgtgcccagagtcagcaatgtatgagctgttggcaactgaatatatacccagttatacccacttccaattacatacaaattaaagggcgggttaatgcaaatagaggggtgggttatttaggactttctaggaaagggtcagtaacttctgagtcattgccatggaaaggtggtaacttctgggttgttgccatggcatttgtaaactgtcatggtgctggtaggagtgtatgatgtaaatgagcaatgagggcaactagggatcactttccttgctatctgctggctcttgctggttccttcacttcatcccagtgggaaataagtcctgcttgtgtcctacctccgtatgattttaaggttgtgttacattcggtggtgtcctggtagatgcttaacaactcgttgtggggcagggatgggggaaggaaggggacctgattttagcatttggtgattcctgggttgtaaatactcccagcagggctgatttcaagttgccaatgtgacatcactgaaagcagagttggcaagagatgctcacccacaattgactccccaggctgctgccagcttataggagccagctccaggacaccactacacgtagtgctgaaaatgcaaaaaggaccggctgcttaactgatcctaagggacaagcaactcgaaaaacaccacagaaagccatggtttccagctgccaagagggaagccaggttccttctataatgtgggtgaagtctggataccactagggtctactgagctgtatctttatgagagtccactgaatctcaccctatcatttttcccacttgtgatccctcagacatgttatccccttgatgtctagattattcagagggagtgaaaagtggcagcactgtagaacagcacaactgaaggaagggattgatgaagctacaggtctctgacgaagagactttaatagcttttattctagtgagggtgccaggacaaagtgtttggtttttttaataaaatatataccatcaagatatgaaccaccaatatattagccaatatgtaaacatcagtcagtccagaatttagctgaagaaagagaacattatcagtctctttgaagcttcctatgtgccgctcctccaaatccccctaagagattatctgtatactgaattttatatgtataattccctgtttttaaaaatcattttaccacttaagaataggctattcagttttgcctattgttgaaatttatgtgaaagatactatattgtgtttgttcttctgcaaactgttatgttcaatattatgtgtattaaaataatttatgttcatgtacataactagttcttttttgttgttttgcagcatgattttagcattccatattatatggtctacaacaatttatctttcttctgtcaatggttatttgaattaattttaagtttttttctatttcagaaaatgctgctattaatctttcttgtatgtgtctcctggtaaatacatgcaggaatttctgtaaagtatatacctaggaatggagttgctaggttgaagtaaattgtatctctaagaagtttgaccacttacaatcccactagcagtatttgagaccatcttagactatgttctctctaacacttggacttgctatacactataattctaataatttgaccacagattcttttgagttttgtacattcacaataatactatgcatgaataaggacaattttgtttcttctttcttttttaattattttgcttgctctccctacctcatcttttttgcttgttttattacatttattacaatcaccaatacaaatgccagtggagtaaaccttggtttgtttctgttcttgaaaaaaatgctttgattattcatcactaagtaggacattggctatagactttttgaaaacctgaatggatattgaattttatcagttgattttctgtatctattgagagaatcatgtgttttgttccttttatcttttaaagtaataaattatattgctatattttatactttttatgaaaacttgtatttctgagataaatccaacttgttcacaatgtgttgcttttttatatacatggatatacatgaatgtgtgtgtgtatgcgtgtgtgtgttcagctatttggtttgctaatattttaaaaattttgtgactaaacttgtgagtgagatcaaactgtgatttttttttctctcttaatctgcattttattattaaaggtgtacaagccttaaaaatgagttatggcacattatctcttttcctagtctcttaaagattttgtgtcattttgtgtatgattgaaataatcttttctgtcaatgtttagtagaactttctagtataactttctgggtcagatatttactttaggggaaattaattcaatttatttgatgattataataccaaattattttttatttcattgagaattgattttggtgatttagatttttctagaaatttgcttatttcatctatgttttgaatgtattgtcttaaagttcttcataattttttcttcttatttctgccttatttctggttatgtccttattctcatttctaatatagattatttatccctgttcactttctcattgatcagtgtcactggagtttatcagtcttattggccttttcaaataaccaacttttaattctattaattctatttaatttttgttttccattatttttcctgtatgattttctttcttttttctttagtctattcagttgatatttttaataattacttatatctttaggttagtaatttgcagtcttttaaaaacttttttaaaatatgcatttaagactataaatttcccttgaagtagtgctttagctttatgtttgcaaattttgatatttagtgttttcatttttatttttatctaagcatcttctagcatcaaatatgagtttttctttggtctatatattgtttaaaggtgtgtttttaaaatttcatattgcatagtttttttaagcattatttctgtaacttaattaaaaatgtgattggataatatggagtgtattttatagattatttgatatctgttcaaatttgctttatgttctcttacacatcagtttttataaatgtgctaggtgctcttgaaaagattatgtctcactcatatctacatcttgaataatatttttcctcagtctaatatatcagttattgataaaatgtgtttttcatctcctactatgatggtggattttcaatttcatctttagttctatcaaaatttctgcttaatgtatatatgtaaaaatatgatattagtactttttatatatgtctggtcttttcaacattttgttattatttagtgtctctatatagagaaatgctttttaggccttcaagtgttctttggcatttataaagtttaaaaatttttcttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtatattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatctctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtccttggctctgtttatatgctggattacatttattgatttgtgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctttgatagaattcggctgtgaatccatctggtcctggactctttttggttggtaaactattgattattgccacaatttcagctcctgttattggtctattcagagattcaacttcttcctggtttagtcttgggagagtgtatgtgttgaggaatgtatccattttttctagattttctagtttatttgcgtagaggtgtttgtagtattctctgatggtagtttgtatttctgtgggatcggtggtgatatcccctttatcattttttattgtgcctatttgattcttctctctttttttctttattagtcttgctagcggtctatcaattttgttgatcctttgaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatccaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaataataataataataataataattttaaaaaaaatttttcttttagttttgtcttgtatatttctatttttttaacttacaaatttcctacatccttatattttaagtgtaaatgttgtaagcaaagtatagctggattttttttaaatccattctgaaaatcattgacttctaacaagtgagattagtatatttatgtcattgtgattataaatacatgtggatttatttctaccattttacatcatttaaattctaatttttaaatatttttcttcttttaaattgttttgaccccattttactttctcccttctaccaacttataagatacaacctctgtttttacttgtttagtactttcctagaaattacaatatgcgttgttaatttaataaagtaaaaagttaatcagtgtattaaacctccgtcaaaactatatttttactttgggacctttgactccagttacctccattccagatgacataactattattttctgatattttactcctatcttgccgtggttttctacactcagcaatttgacattataattaatgttttataaagccaatgattgtttaaatttaccacatatttaccacttctcttggtttactatttcttcagactttccttctagattattttttatgtttagtacatttttgagaaattccttcagttaaagatctgttgatgttagccctctcagtttttacttgtttggaaatgttaccatttcacattaataactgaaaaaaacataggtatgcaaatcttgtgtggataattttttttctcagtatctattcttttagaatcttgcctccaaactcctggttttgagaaatcaaccgctctctatgtgtaacactcttttctctgtgccatacttcgagacttctctgaaatttgattatagtatgaatggtgttgaatttttaaaaattattgtttatctttcttaggattcatagggtgtcaggaatctgatgtgtctcatcaattctgaaaattcacagccatgatctctttgcatattgtctctccctgatgctttctatcttttcctcctggaaatctctttagatattttagacctattcactctatcttccatgtttgtttgtttattctttttcctattgatagtgcagctgggtaatttctttacatctgtttttgagtacgctaattctttctttagcagtttccaattagtacttaataatttcttgaatttctcatttaaattgatgtaattttcattcctagaagctttgactcttaaaactttgttcatttgtataattatttgatccattttcatacttttgacatctttttagttctttaaacttctctgctcatatagtattttcagtcagataattataaaatatatgactcgacgtcacttctgcatttgagacaaaaggaaagtggcaaggaaagaaggcagtgataagtacctctagggactctttttcatctggaaaaagaaagcagtcctaaaagtcatcccaatgtctccgcttatttcttattggacaaagctctgtcacaaaaccatcctcacactcaagaaaagtaatgaaagcatatttttagctttttcagcctgtatgctggaaagtggccagatgaaggggttagaaatgtaatttaagttagctgtggcatttgccccagtagcacagaaggagatgctcaggaaccttttattgaatctgagtctgaaatgcaccatctcatttagtcacactgggtccacaaaagggaggacagggaagaaagctgagaaagcatgccagctctgttgggattcctgtgaacatgtgtggaggtgattccacagctcaaagaagataacaggggatagcgatatttttctctataaaaatctatccttgttttccttattttgggtggaatttgaaaaagggtaaatttataagagaaattaaaacatgcttatttaaaaaaaaactctccatgaacctatatgtgaatgttcatagcagctttactcataattgacaaaaactggaaacaacctaaatgtcctccaatgggtaaaacaataaactattacatacatacaatggaatgctactcagcaatgaaaggaatactcaatgtgtgcataatatacacacaatagcatggatggatatcaggggtataatgctaagtgaaaaaaagcaagactcaaaaatctacgtactgcatattttccttatatgaaagaggcaaaattatagggatggagaacaaatcaacatttgccagggcttggggatggggagatgcgttgatgacaaaggggcaatatgagggaattgaggggttgggaggaggtgaaactgcaaatcaaagataaataaaaatttaaaaatcactttttgaggaggaaaataaagaattaaatgagaaaaatctaatgaaaagagtgaccgtcgagtttgaagatacaggaatatataaaatatttctgtctatctaggaagatatagaatagataagaataatcaatagagcaagttctctgagaagttagccaacaggatctaaactataggtgtagaggttgactttagataaacaaggggacaatattttcttttgagatggagtttccctcttgttccccaggctggagggcagtggtgtgatcttggctcactgcaacctttgcctcccgggttcaagcgattctcctgcctcagcctcctgagtagctgggaatacaggtgcccaccactacacctggctaatttttgtatttttagtagagacagggtttcaccatgttggccaggctggtcttgaactcctgacctcaagcaatacaggtgtccaccaccatgcccagctaatttttgtatttttagtagagatggggtttcatcatgttggccaggctggtctcgaactcctgactcaagtgatccactctcctcagcctcccaaagtactgggattacaggcgtgagccacagcacccagctggggacaatattttctttgttataggaattaataggaaaaagatgagagcaaattcaggtaaatttgtagatttggagaagtgtaaagataaaacattaaaaaatgtgcaaaagggatagcagggattttttatattgaggaccaataccagtcaactggtggtagctgactaatgtattgtgttaggaaggatttacaagcaatatcaaggatcaggaaatgagaagactaggatctagtggcaatgtctgccacaagttttagacaaccaattaccttctattatttcagctaattctctctaattgtatgtattgtaagaaatcacacacacattctctacctataataaccttacttttccacttctctttgtttaactaaaggctattcacaagccgaggaatttgagactagcctgggcaacatggtgaaaccccgtttctaccaaaaaaaaatatgtaatagtacaaaaattagccagacatggtggcgggtgcctatagtcccacctacttggagggctgaggtgggagcatcacctaagcccagggaggtcaaggctgcaatgaaccatgattgtgccactgcgctccagcctgggggacagagtgacaccctgtctgaaataaaagctatttacattaggagtcctcattaagcaacccctctatatatgcacccggaatagatgagatgcttcttgtgtgctcttcaagcatcctatatgtccctcttcaccacagttaccacattagattgtaagtatctatgtatctctgcctaccacactagaatagttgatccttgaagaggaagtctgtaactatattcctattatttaacctaagaggtggatagtaaaattatttttgagtgcacaggtgaatgaaggaaactaaaatagctccaatatggcgtgtgaatcttaatttggaattcctggaagcagaagctgagagggattctcgtgcaagtgacttagtgaaggactgccctcaagtgaaacccataaagaagaaagggaggcaggtgggtgaagggagagagcgaggcaaaggtgtatcagctaaagcctttcctgagcctgatgccacaaggagctctggagcgtgaagagcaccactgaggtatcccaccctgagacgagggggccgccgttttaccctgtgctagtctttcatgggctgtaggactcctctgggaaagggtataacttgcctgtcattttcaagatggttcccatcagctgaggagaattttcccaagaaatatagagccatgaactgttcgcagccaatgctcatagccgctaaggaatggatgcactggctttgtcaaaggggatgtaggcagggaacaatagggtctattgcagtgtgacaggacaatgggaaaggggttatgggaacataggtgggaccctgactcccatgacctctgagatataggaaaaggaaggagaaagagaagagggatcctcttcccctcacctcccaccccacatactcctttcctaggtgagagttggcttgctgccttggcgttgtggctaccaaagacaggtgtctgcacagcaggctggatgctcctgagaggcaggttggctttgcagagagctgaggtggacttttgctgcatccccttcacacagttaaattattccatggctgaacacatggggagggttgagctagatgaaaaaaacaaatcttctacaaacctggaacagctgtaaaagaaatagagttgtcaaggtcagcaatttcatctctgaagaaaggtgagaccagtaagggagaacattcccctgggactacatttaatggtcttctacctatggaagtattactatccaaaatagtgatccagtttcctgacagaaagccttgtcccatggattggcatttgcttgcttggaaaatgagttttcaacctttcgagaatcgaaacagtttgtggtatttacaatacagccttactgtccagtagctaagtgtagtctaattctaacagatggctctccagggaaattttccttcagattggattatgcttccaggctgaaattcactaattaaggggagtctaaataaacatagtgggggagtgagagggaggggaaggtaggctgtttcttaggaagctgttttggaaagtggccatatttgcaatctttatctttccagctccacacactcagctatgtggagaatctaggccactgctttgctaaagacatggtagtgctggatcaagggtcagtctgccttcagcaaggagctatgacttcgttttctataaggccctggctctctaacctggttttctcctatgttacctgtcttgaaatgtagcttccagaataaatgtatctttaagatgagcatgactgactttaaaaactgaacagatctatgaatttggctctggtaaacattgctaaccttcttttataaaaagtctaatactttggttttgaagtctttaatatgtaaagatactcctctattacacatttcttaatgcttaccagtttgagacctaaatagctataggacaagtacatatggctatcagatatggaaggatgaattttgcatgagtgggctgagaaaaatccaatttgcaagtcaggaagtgagttctgggtcaggaagttagttgcagttttgtctccatcatcattcaacaaatgtttttgaatactcactgtctgccaggcaatgtattggacatcaagcacataatggcccttaccctcttggggcttttggttttgggagatggaaatgtgggaagaagggacagatagtgaaacataacattgcacagataattactcacatgtgttattggtgctgcagaggaaacgtaggcaagcgcttcctgtggcacctaacctggcctggtatattaaagaaggatgcttggaggaaataacattgaagctgagacaaaaggatagttaggcatttgcctgaagaagggcagagtcccacgcaaaaggaacaggaatgtggaaaggccccaagacaggaacagttttggcaagttcaggggacaaaaagtgcagggtggttaaagatagggaaataaaatggaagagagaccagaactcaggaaggagcaagaataattaagatttttaagacaagaataagtctttgagtctttatgagtaattttgggcagtgaattgacacatagaaatttacttttttaaaaaatcactctggctgcagtgaggaatggacaggaggggagagtgaggggatggtcaatctattatagaaggccactcgcgtgtggttaatagacatggagaaaagtagcagattccagaaattatttaagcagtttcactgaggaataattgtatgtaattaactgcatatgtttaaagcacacaatttgacagtatttgacatatatatacatttgtgaaaccatttaccatagtcaatcaaaataatgaacgtatctgtcacctcaaaaccttgcctgtacccctttgtaacctctcctgcctccactccctgccacccatccccccaatccccaggcaggtgttgatctgttttgtcacactacattagtttagattttctaggattttatagaaataagcatcatacagaaggtactccgcttttacttctttcaatcagaataattatttttgagattaattcatgttgtatgtattaataattcaatctttttattgctgagtactattccattgcatagatatgccactttttgtttatcccttgcctattaatgaacatttgggttattttcagtttgagatattacaagtaaagctgccatgaacattcatgtgctttgtatggacatatgcttttacttctctcacataatgacctaggaatagactgctggattagatggtaggtgtatgtctaccttttgatgaaattgctaaactgtttaccaaaatgattgtatcattttacatttacaccagctatgaactgtgaaagttctagttgctctacattctcaccagcacttggtagagttggtctttcattttagacattctaagaggtatgaaatagaatctcattgtgatttttacatttccctaataacaaatgaaattgagcatcatttcatgtgcttatctaccatctatttatcttttttgataaactgtacaaaatctttggtcaatttttaatagtgttctttaactttcattttaggtttagtggtacatctgtaggtttgctatataggtaaacacatgtcataggagttcgttgtacagattatttcttcacctgggtactaggcctagtacccaataattattttttctgatcctttccctcctcccaccctccacccccagaaggttccagtgtttgctgttcccctctttgtgtccatgtgttctcatcatttagctcctacttgtaagtgagaacatgtggtatttggttttctgttcctgtgttagtttgcaaaggataatgacctttagctccattcatgttcctccagagaacatgatctcattcttttttatggatgcatagtagtccatggaatattttttatggctgcatagtattctgtggtatatatgtaccacattttctttatccaatctgccgttgatgggcatttaggttgattccatgtcttgctattgtgaatagtgctgcaacgaatatacacatgcatgtgtctttatgctagaacaatttatattcctctgggtatacacccagtaatgagattgctaggtcaaatggtagttctgtttttagctcattatcgccacactgctttccacgatggttgaactaatttacactcccaccaacagcatataagcattctcttttctccataaccttgccagcgtctgttattttttgactttttagtagtagccattctgactggcatgagatggtatctcattggcgttttcatttgcatttctctaatgatcactgatactgagctctttttcatatttttgttggtcacgtatctgtcttcagaaaaatgtctattcatgtcccttgcccactttttaatagggttgtttgtttttctcttgaaaatttgtttacattccttataaatgctggatattagacctttgttagatgcatagtttgcaaggattttctcctgttctgtagtttgtttgtttactctgttgatagtttcttttgttgtgcagaagctcttaagtttatttagatcccatttgtcaattttagctttagttgcagttgcttttggcatcttcatcattaaatatttgccatttctatgtccagaatggtattgcctaggttgtattccaggatttttatagttttggggtttacatttaaatctttaatccatcttgagttaatttttgtatatggtgtaaggaaggggtctagtttcgatcatcttcatatggctagcaagttatcccagcaccatttattgaataggcagtcttttccccattgcttgttttttctcagctttgtcaaaaatcagatagttataggtatgtggccttatttctgggctctctattctattccacaggtctatgcatctgtttttgtaccagtatcatgctgtttcaattactgtagccctgtagtaacagggtaacatgttgaggttggggaatgtgatacctccagctttgttctttttgcttagaattgccctggctattcgagctctttttggttccatatgaattttaaaatagtttctgctagttatgtaaagaatgtcattggtagtttaataggaatagcattggatctttaaattgctttgggcagtgtggccattgtaatattgattcttctgatccatgagcacggaatgtttttccatttgtttgtgtcatctctgatttctttgagcagtattttgtaattctcactgtagacatctttacctccctggttagctgtatccctaggtattttattctttttgtgacaattgtgaatgggattgcattcctgatttggctctcggcttggctgttgctggtgtgtaggaatgttagtgatttttatatgttgatttttgtatcctgaaaatttgctgaagttgtttctcagcttaaggagctttggggccaaaaagatggatttttttaggtataggttcatgttgtctgcaacccgagatagtctgacttcctctcttcctatttggatgtgctttatttctttctctgcctgattgctctttctctgcttgattgctctgatcaggactaccaatgctatgttgaatagaagtggtgagaaagggtattcatgtcttgtgccagttttcaagggaatgcttccagtttttatccattcagtattatgttgcctgtgggtttgtcatagatggatcttattattttgaagtatgttccttcaaggcctagtttattaagaatttttaacataaagaggtattgaattttatcaaaagccttttctgcatctattgagataatcatgtggcttttgtctttaattctgtttatgtgattaatcacatttattgatttgtgtatgttgaaccaaccttgcatcccagggataaagcctacttgattgtggtggattaactttttgatgtgctgctggatttggtttgctagcattttgttgaggatttttgcatcagtgttcatcaaggatattggcctgaggttttcttattttgtgtgtctgccaggctttgatatcaggatgatgctggcatcacagaataagctggggaggattccctcctccacagttttttagaatagcttcagtaggaattgcaccagctcttctttgtacatctggtagaattcggctatgaatctctctgtccctgcacttgttttggttggtaggttatttattcttgtttcaatttcagagcttgttactggcctgttaagggattctgtttcttcctggttcagtcttgggaggatgtatgtgtccagggacttatctatctcttctaggtttttaaatgtgtgtgcgtagaggtgtttgtagtagtctctgatggttgtttgtatttctgtggcatctgtggttacatctcctttgtcatttctaattgatattgtctcttttcttctttattaatctaactagtgacctatctattattattagctttttcaaagaacaagctcctggattcattgatcttttgaatgatttttcatgtctcaatattcttcagttcagctctgattttcatttcttgtcttctgctagtttagagttgcttcactcttgcttctatagttcttttagttgtgatgttgggttgttaatttgatacctttctagctttttgatgtgtgtgtttagtgctgtgtatttccctcttaacactaccttaactatgtaccagaaattctgttatgttgtgtctttgttctcattagtatcaaagaacttcttgatttctgccttaatttcattatttaccccaaagtcattcaggagcaggtggtttaatttccatgtaattgcatggttttgggtgattttttgtctcgatttctatttttattgtgctatgatctgagagtgtgtttagtatgattttggttgttttgcatttgctaaggattgttttatgtctgatcgtgtgctcgatttgagtatgtgccatgtagtgatgagaagaatatatattctgtttttgagtggagagttctgtagatgtatatcaggtccatttggtccaatattgagttcaggttctgaatatctttgttaatttcctgcctcagtgatctgttgaataatggcagtggggtgtttaagtctcccactattattgtgtgagagtataagtatttttgtaggtctcttaagaatttgctttatgaatctgggtgctcctgtgttggatgcatatatatttagaataattaggtcttgttaaattgaactctttaccaatatgtaatgaccttctttgggctttttttgtttgtttgatctttgttgttttaaagtctgtttttatctgaagttaggattgcaactcctgcttttttctgatttccattttctaggtagattttcctccatccctttattttgaggctataggtctcattgcatgtggaatgggtctcttgaagacagcatgtccttgggtcatgctttttttatccagcgtgccattctgtgccttttaaatggggcacgtaatccatttacattcaaggttaatattgatatatgtgcatttgatcctgtcattgtgttgatagctggttgttacgccagcttgtttgtgtggttgcattttagtgtccctggtctgtgtacttaagtatgtttttgcactgactgctaacagcctttcctttctatatttagtgttcctttcaagatcttttgtaaggcaggtctggtgataacagactcccttagcatttgcttgtcggaaaaggatcttatttctcctttactagggaagcttagtttggttggatatgaaattcctggttgaagatttttttttccttaagaactttgaatataggccccctaatctcttctggttcgtagagtttctgctgagaagtctgttgttagtctgatggtgttccctttgtaggtgaccagtcctttctctctagctgcctttagcattctttctttcatttcaaccttggaaaatctgatgattatgcatcttggagatgatcttcttgcgtagaatcttgcagggattttctgtgttttctgaatttgactgttggcctctctaagaaggttggggaagttttcatggacaatatcctgaaatatgttttccaagttgtttgctttctcctcatacctttcaggaatgacaatgattaatagatttggcctgtttacataatcccatatttctcagaggttttgtttgttccttttcattgtttttttctttatttttgtctgactgccttatttcaaaaagccagtctaaaagttctgagattccttccttagcttggtctgttctgctgttaatacttgcaattgtattgtgaaattcttgtaatgtgttttgcagctctatcaggtcagttaggttctcttttatattggctattttttctatcagctcctgaataattatattgtgattcttagttttcttgagatgagtttgccattctcctaaattttaacaatccttgttcctatccatattctgaattctatttctgtcatttcagacaactaagctttgtaacaaacccttgttaaagaactagtgcagacatttggaggatataagacactctgactattggagttgttggagttcttgtgctggttctttctcatctctgcatgtgggtattcttttaactgctgggctgcttctgattgaagtggtcaggcaggagcagggttattgtgctagagtctgagatcaggcagccctaaccagtgaggataagtgaggaccaggacctgtatggagaacaatccagtcacttttctgtgaggtaggtgttctgtactggaggtctggacaagcccctggtgcctgcagactctctagagcctggagacagcaagggtgatggctgcaagacagcaaagatggtaatccacccttcccactgggagttctgtcccaggcaattgcagagctattactggctcagtagccccagtggggaatagtggagtcttaggccaggaggccacatccagtgaggagatacaggattagggagccacataacaaacactctggctactttttcacagggctgctgcagtgtgctgggggtctgctccagttcctactcaccttggattttctagcacctgaaagtatcaacagtgaaggttgtgaaacagcaaagatgatggtctgtccctacctctgggagctctgtctcagggaagtttgaagctgttactagctggaaaacaccagcagaggtgcttgtagaccttggctgggagattctacccagtgaagagaaatgggatccaggacctgcatgaaaatgcagtcttcctgcttcttcagagagctgctgtgctgtactggaggactgctccagtctctacacacctcggactcctttgagttggaaaacattaatcttgtgtttaggcacaggatgtaagggctactggaagatgcttctgatatgcgttggctgtgtccccacctaaatctcatcttgaaatgtagctcccacaatccccatgtgttgtgggaggaacctggtgggaggtaattgaatcataagggtggatttttcccatgctgttctcatgatagtgaataagtctcatgagatctaatggttttataaagggcagttcccctgcacacgttctcttacctgctgccatgtaagacatgcttttgctcctctttcaccttctgccatgattgtgaggcctcctcagccatatggaactgaatccattaaacctctttttctttataaattacccagtcttagatatttcttcatagcagtatgaaaatggactaagacagcggccatgagactgagttggttttatgaagcagaggagtcaagtttaaatcacatatatgattacatatgtgtaatcatactgtgtgtaatcatactgatatgactcacatctcagtcatatttgcaagaagcagtcagtctttgtattatttcattttcatgctgctgataaagacatacccaagactgggtaatttataaagaaaatggtttaatggactcatagttccacgtggttggcaagacctcacaatcatggtggaaggcaaaaggcatggctttatggcaagagggaatgagagccaagtgaaaggggaaaccccttataaaaacatcagatctcatgcaacttattcactgccatgagaacagtataaggaaaactgcccccatgattcaattatctcccaccaggtccctcccccagcatgtggaaattatgggagcgacaattcaagatgagatttgagaggggacacagagccaaatcatatcattccacccctgggcctctcccaaatctcatgtcctcacatttcaaaaccaatcatgccttccccaaagtcccccaaagtcttaaatcattttagcattaactcaaaagttcatagtccaaagactcatctgagacaaggcaagtcccttccacctatgagcctgtaaaatcaaaagcaagttagttacttcctagatacaatggaggtacaggcattggataaatacacgcattccaaatgggagaaattggccaaaacaaaggggctaaagaccccatgggagtctgaaatccagcagagcagtcaaatcttaaagctccaatatgatatcctgtctcatatccatgtctcatatccaggtcacactaatgcaagaggtaggttcccatggtcttgggcagctctgcccctgtggctttgcagggtacagcctccctcccggctgctttcgtgggctggcattaagtgtctgcagcctttccaggtgcacagtgcaagctgtaggtggatctaccattctggggtctcgaggacagtgaccctcttctcacagctccagtaggcagtgccccagtggggactctgtgtgggggcttcaacaccacatttcccttccacactgccctagcagaggttctccatgagggccctgcccctgcagcacaatctgcctggacatccaggcatttccatacaacctctgaaatctagacagaggttcccaaatctcaattctttacttctgtgcacccacaggctcaacactatgtggaagttgccaaggcttggggattgcactctttaaagccacagcccaagctgtaccttgaccccttttagccatggctagtgcatctgggatgtagggcaccaagtctttaggctgcacatggtaggggtacactggacctagcccacagacccattttttatcctaggcctctaggcctgtgatgggaggggctgctgcaagggtctctgacatgtcctggagacattttccccattcttttggtgattaacatttggctccttgtgacttatgcaaatttctacagcaggcttgaatttctccttagaaaatgggtttttcttttctattgcatggtcaggctgcaaattttccaaacttttatgctgtgtttcccttttaaaactgaatacttttagcagcacccgagtcacctcttgaatgctttgctgcttagtaattttttctgccagataccctaaatcatctcccttaagttcaaagttccataaatctctaaaatgggggaaaatgttgccagtctctttgctaaaacatagcaaaagtcacttttacttcagttcccaacaaattcctcatcttcatctgagaccacctcagcctggatttaatggtccattatcagcattttggtcaaagccattcaacaaatctctaggaagttccaactttcccacattttcctgtcttctttgagccctccaaactgttccaacctctgcccgttacccagttccaaagtcacttccacattttcatgtattattacagcagtgccccactcccagtaccaatttactgtattagttcgttttcacactgttgataaagacatatccaagactgggtaattcataaagaaaaagaggtttaatggactcacagttccacatggctggggaggcctcacaatcatggtggaaggtaaaaggcatgtcttacatggtggcaggcaagacagaatgagagccaagcgaaaggggaaacccattataaaaacgtcatatctcatgagacttattcactaccacaagaacagtatgctggaaactgccctcatgattcaattatctcccaccaggtccctctcacaacacatgggaattatgggagctacaattcaagatgagatttgggtggggcacagccaaaccacatcagtctttatggcagaagaggggaagagaagctttccattgtgaacacttccacacttgattatttccttcttctttggcacattcctcattaatttccaccaggaggaggcatgcagcccagttcccctagtctctcttcctaaatcccccatctttttttttcgtttttattattgagttgtgagagcttttaaaatattctggatgccagtcctttatcaaatatatggtatgtgaatattttctcccaagctatggctttttattctcttaacactttcttttgaaagagagacattcttaattctgctcaagtccatttactcaatttcatcttttatagggtatgttttcagtggcgtgtcaaagaagtcctggcctaatccaaatttatacagtatttttttttactgttttactctagaagttctatcattttagctcttgcatttataactacaatccattttgagttaatttttatgtatagtatgatatggtttgaagttctttcttgtgaatgcatatgtgtgtgtatactataaagttgttccagcaccatttgttgaaaagtctatattttatccacacaattgtcttttgcacctttgaagaaaataattgatcatatatatgagtctattctggactctctattcttttccatcgctctatttgtctagctttactccaatatcacagtgtcttgattgcagatttataaatcttgaaatcaaatagtgtaagtgctgcaactttaccctactttgtcaaagttgttttagttatctaggtcttttgcatttccatatgaattttataatcagctcattattttacacacacacacacacacacacacacacacacacttgaatttttattggggttgcattaaatatagaatcactttctattatttggaaataataggaatcttaaaaatagtgagtcttcccatcacaaacagtgtatctctctccatttagtacatcgtctttaccttccctcagcaatattttctaagacaggtctctcgagctctctcattgtttatcgttctcttctctggtactctaccctgcaaattctaggggggatggcctctccagactcccaagtccgtttcctcaactgagggagcccactaggctctgcctgggttttcacctgtctgtactgtgtctctgaaactttctccaggtggtgacatgggcagttttagttcttgcctcatttgtttcctgtcactcaaggatcacatatcttcattacctgatgtccaatcattgtttcatatattttgtccagatttttagttgtttaaaatgtgagagtaaattcatttcctgcctctctgtcattgtcagaagtgattgattttatgtgagaattgaagaaagagagtggtcaaagatggatgattttctggttttcagcatgagcaaactccagatgttggtatttactgagatgggaaatattaggtgaagaataggctgtattctggtataagtaagatcatgtgttccatttttaacatattcagtttgtgctacctgtgagacattcaagtataaaaaaatcaaaaaacagttgtatagactaggctggagctcagaagcagggcctgagttggaaatatgaattaacaaattgtcaacatatcctgtttatggtatttgaaaaatagatgttgacaaaggtctttactagcagaatgtagagtgataaaagaggaggacagaggtccagtttttgaagaatactaatgtttagacttcagatggaaaagaagaccttaatctgagcagagagagccaaagaggtaaaaggaaaactggttgattgtatcatggaagtcactagaagaatgtttcaaggaaccaagagtggtcagagtcactctgactgagagagtgacaaagctacattgaagttgatgaagaaaggactgaaaagaacccactggattatgtgacggcaaagtcattggtggctttagtaagggaactttccatagagcagtaaggaccaaagccagaacagagtagactggaaagcaaatgacaggaacaggaggcagcatgtttaaatagctccgtggcacatttggctgcaaaagggaagaggaggactgaaattgggaaggaatttttcaaaatgggagaaaacagattatttaaatactgacagctaagagccagtagtggggaagcctggagatgcaagaaagagaggatgagcagcagagggggttcctgtggctgagaccccatcggatggcacgaatggatgggacccagaacagagttggcggatttgcttttgataaaactcttcttcccatgttgcagtgggagggagaggccaatgcaagtgcaaatacatttatgaatccaaaggtaagaagtcaagtgtagcccttctgatgtctctgtcttctctgggagggaagaaacagggctgtgtactgagcatatggaagagcctctgccttcagggagcttgtggtcttttggcgtgtactgctctgatgatttcttttatagtaactacaaaatcagtctcacttcaacttgcgtcccttttaaattttaaaatgttttacttttcaaaaataatttgctggattttccttgattatgtaatctgtctgctcaatacagaaaacttgaatgaaaacagaagagtagataattctgatacaaagtcacctatagtccctctgccctaaagtaaccactgttaaagtttgatatatctttcctgtataatctctgtccatggttcttcacttgcaatttttatatggttgtgacactattttgcctgcttctttgctgtaatttgtttaagtaaggaaactaaacacaaagttttgtctcaaaggaccatttctgcaggtgggtggggcccctgttcctgaacagggcttcattccctttgtccatgtttgctgagatcagggcttccctgctagccaggcatccctgaacaagccaaaatgcagagcacagccttcaaaggaagcttgtctgtcttctctctttggaggctgaggggtcacagtcagcgtacccagaagagaagctgggacttatcaattaaccaatactgctttcaaaccgttttcatcaaaatattttttttttttgagatgaagtctcacgcttgtcccccaggctggagtgcgatggcacgatctcagctcactgcaacctctgcctcccaggttcaagcgactctcttgcctcagcctcccaagtagctgggattatgggcaactgccactgtacccggctaattttttttgtatttttagtggagacggggttctaccatgttggccaggctggtctcgaactcctgacctcaggcgatccacccacctcagcctcccaaagtgctgggattagagatgtgagccactgcgcccagccgaactatttccatcaaagcatggggaagtttcatatgcagcttcagggatcttggggctggcagctgtcaaataagcatgctgtgggaactggggagtcaggaagattgtggatatgtgcttctacttgtgcctagaggaaaaggtttcctcttgtttcacaacagccttggccagcagctttttgagggagtgggaagcaggacaaggaattttggtgtctgccagattgagacagggatcaagaactgagtgaggacagagcgtgaaagagtggtctcaggcctcctgaagcatttgttctttcaacagacaggctccgtgctagcactagaatgcccatggaaactgaaggaggaaaccacaggctggcagaaggctaagtctgtggcatcagagcaggaagcaattccgtgaaacagcgactctgctctagctacatttatttccctctgttcctggaggagtgaggggaagggggagacatccttttctaacaagggactttcctgaatacttggattttatattaattcatgctttcagaatttaaaggaactctttctgcacagagggagtcccccatcaggtcatgcaatgtttaacaattatggtttggccacattctcctagaaaaactacaggacctcccccttcaaagacatatacaactccaggaagccacctgaaaatcttgtgttggtccctgtaccaactctacccccctcctcagtctctattaatctgttcccaaaaagaaatgtcaccagatggccctgcaaatgtcacctggccatcagcatggcttcactcaaaacagggaggcattagagaatctaatccatcgttcatttccatcatttcgggtcagtttgcatcctttactgggcatatagtgctttcttaacacactgggttggacagtaagatctgtaatcctgctgatattaaagaatattgcttcacgtttaatggaggaaggtcccagtgactcacagatactgaacattctgtaagaactcctctcttgttagcatttaataccagattttactgccctcagcttcatgaactgagcactccctcagcattctcaatgcctcaggctatctttagcatttaatcccttccaggtatcagagccatcagacctcctttttttttttttttttttttttttttttgtattttcaaagtgcggatgggtggattttaggaattgagctgatccctttttaaaatgggtttttcttttactgtctcttagatttcatatccagtcatgggcatcagacccgtatcctgtctctgctctgtgtatttctccattctagcagttacagaaatagctgagggaggtgtgactggttctggagaaagaaaagaaagctgaactcctcacgctgaggaggttgcagggccacagctaggcgggctgggggtgggaagatggctgtactgctgggctgtcaggcagaggggccacacatccagatgtgcttttgagctccccgcagcttttagggagtggcttccaaatgagtcataaaactcagaggtaggtttggaataggagatttcaagtgggctcctgctcactgtcagagccacttactctctttactggggattaaagaactccacgagcattgccggggactggggggaggggaaattgtttaatggatacagagtgtctagttggggtgatgccagcattctggaatagacagtagagatggttgcacaacactgtgaatgtacttaatagccactgaactgtatacttacacatggttaaaatgataaattttatgatgtacattttaccacaataaaaaatatacaaacacacacacacacacacacacacaccatgaaaactctctaccagagtgcaaataagacttggagacaacagagaaaggcgcaggcccaaatgcacagagttgcccctgcctccagccagttgaggtgggctgcgggcaggggtcatgttcctacaggggccacctactcatcttagcagagactccatacagcaagggctgggtttccctcagcttcccagagcccaggcctatcaccctaccaacgtctgtcccaacaaatccatgcacattgcctatatgccagaccccagttctagtgtgttttccacttaattttcacagaagtgaaatagctattatgcccatatgacagaataggaaaatgaggtatagaagggttcattactcgcctaaggccacacaagtgataaaggtgagatagcatttaaatgtaagtctatttgaagcctgtgttccaaaactcagttttcccgattatactacacttcaaaatatccatcttggtaaaaaaataggtcctgaacaatgcttccatcaactctagaataaaaatgagtttgtatcatgatttgaatccagtacacttcagagacactggcattctgctgctttcatcacactccaccctgtgagtcactcatgccagggggggacccaccgaggatgcctcatgggtcaatatagtttttgctgaatagatgatacatcagaggctgaataaggatcaggctggccggacagatttccagagaactaatcaataaagggtactaaaacattgaggtggaggaacctattaatctgtataactttctagaagaacattacatatggttggaaataatacctgaagaagtgatgacattcccaaatagctcaagttgcagtagatgctcactaatatgtcttctgaaggtgtaggtccaggcaaatgcaggcttcaggcttgagctatttgggtggtaaaggaaagactagcactgtctccaacaaccctctttgtctacccatcagagcagccaacttctcataaacactgaacagatatttaaataacatcagtttgaagaatggccaaagtcacctcctacctgagctgcctacgtgcattgatctgtcctgcaggccacaagtttttatcccctctttcctatgtctcagcctacttctgcctcatagatacacacctcaaaatgcagccctggggcctgggctcactttccttcatcttccatatctcaaggcttatgttagagctcattctcttttctttcaggtccaatctcttctcctctcaatgcccactgccacagctccttctttggtgactggcattgctattgccaccaccaccaactttcaacctgagagcatgatttttccagaagacgtgatgtagaaagagagagaaaataaatgctacttgcattttgacactatctaaaagcaaacagataaatgtttagctttaaaaacatttctaaatgtgtaaaacaattatttatagtggattcttgaccctgatcccattgctcactctcaacctatgtgtgagggatggtcacttatggagtgagattaggcgtgaagtaagtatcagggtaacaaaaccagtgattttttaaatgatgtcatgattttgtcttaaaaaaagtcaagatcaaagcggccagctaataaagtcctggtcctacataaataactagggttttaaaaaattatctttaatgatttttttaacctccttgaaaaagatgaagtggtatatattgcctgtttcttaatggttaagtatcatgaactttggtggggaaagaaactgaaagcccagtaattccctcggtctttatataagaagagtattatctgaatgtcgtttggggcagtggttatatttttaagcatctgtcattcatgctaattgaccagggatgtggctagccagggtcaagctcccacagtcagtgcaagagggccctgaggctttgggcagcctgtccgatggcagccacctaatgtaggatgcagtggcagtgctggcccacttttgagagcagccgctgagttacggactccttgtgtgggagctgtatgtcggactggagctccagactgctcattccctgcccagagccttaccctgtcatcattgattttatggggaaagaaagcatctccttttgtaaacaccacaccagcatcttcaataagatgatgcaatgggattaatgatgcactttccagcatcctcatcgattctgaagatggaagtagaaacttgagatgagactaagccatgttttgtcaacattttgcttctctagcaagcaaaatatcctcaaattgtgagtttacttgaaagatatgctggtatttgaatccccagggctgggaagattctattttacagacatcaccaggagtgtgacactcaggcctgagagtaaggagaaaggaaggaaaaattaatgagtaaccaaccactctatttcagagtctgttgtatgggtgagctggtggtgattggcttgcaaatgtgttttccaggaaaaaaaactctacaggagtggtgggaacaggatgggagtgggagggcacagagggaccaacagaccttccttttctttgcaggtctaggtctgaggatggcccagatggtgagcaattgtgtggctatttagtcaaatcccaactagctcagcagataactgaacatccctgaggggcttgggaaatatatgtgtttgtgaagtgctgtgagaatttacccagtgtagctcaatctgcctcagactgacttctgacataaatgaattttaagaaagtaggcgttttccttcttgaagaagcataaactcatattaggttagaatctcaggagtttgtattcagttgatgtctaggcacatcagagatggagaggagataaatgtctctccagcaaagccgctgggtttgcacacctgtccccaatatctacactgggcttgacagagggtttatgtagactagtcagaaagttgtgcagcagatattcaatactgaaatcaacgaatgcactttattactcacttgcctactatccctggatgacaataagacctagatctacagtttaaagttcagaaatatatgatgcttctcgatggttatgatctgaataacagaagtgaagcgttaaggtaaatattgatgttatttaagaatactcagtgaactaacaggtctctgatgactgtgtaatttatgcctagccccgtgaagaatagtacaaaataatatgacatgtgctcccctgcacttgttatggaagatgagacacacctatgaaaagctgaagtagcaacacagagcaggatgcatacaaacatgtgaaatacacagagattactgtgagctaggaagacgagaaaggcatcaaagagtaagccatttggtactggtccctgaaggtcttgactgcgtgcagtgatcttaaaagtggggtgtgagatgacatacactagggtgcaagaataaaatagtaggacttctatttatattttctcatctttgttatttctcttttgtatgtttattacacacataatgttagaattctatacacgtataaaacttgtaagtaagtaaatatacatatatggggtatgtgccccccaattttttgatgtgcatgtgccagttacaaagttattttctttcagcttcaaattcacccttcattttctgctctggaaaagtcaagttgggacctttaaatatatttccttttaccacccagaacaatgttaagctctgtcagcagagggcacaggagaggcattgcaagaggaacggggtttttttcttcctagctctggtgtcctcccctgaggcttctgcagggaggcacacttcctccagcccccaggaaccactttcctgcaatatgggcagcagcttcagtgcaaggctccacaacacccatggcctctccggcactcagcccctgcagcatatagcaatcagcagcacccagtgggcagcagcttccccaggaacccccttggcgagacaccttcccatgaacagcttttcctagcacctagatggcagatttccggtaagttctactggtgcagtaccacattgacttctctgccattcagtgagtgatggctgtgccctctccaacaaggtctgtgtttcagccttgagggcagggaggatctcttccttgagtgctctgctcctcatatctgctaatcctatagtttttagagttcattgtacttcttgctagccaatccttcattagttcgatcctctgttatagtatttatttatattaagctttccctgtttgaattactggatggtttctctcctgaatgggtccggactgattcactgcacttctattcataaaaaattttgagcatgcactgactgccagtatatgtatattttcttgtttatcaattatattcatgtattatttgactagttttcatgaacacattaaaaacatacacaaaattttactaagataaagatgaaatattgtatatttgaaatattgtctttgaactatcttgattgtaatggctttatactacaattagcaaatatctgaagtaacaatatgaaccaaatatggtgaatcattaatagtaatgattgaaatttaaattacatttcaaataatgatttgattggaattaaaagagggtacctgtgtccatctttatgttcactttgagtagactttattttatttttaaaataacaaacttcagagcaccacattgcacacctctggggcatatgaatcctctttggacacaactgatctaagctacccccttgtctcctttctggtccatcacctatactccagccatagtgatccacataaaaatcacatcactcacttgcttagagcacttcattggctcaccatcagtcttatgataaagtatgaaacttatctatagacaattctgagtgggcttaggccatggtgaatgtgatggtccaaatcctggcagaaccaacatctgtttttttctctagtcttgtcacctaccctcgcttgcctcacaaacaggcctgaggtagggaacatacactgagggatgctgcaccagggcttttcctgttgaaacccaggccctgaggcttggacttccttcctttaatctgacatgtgacccctcctcagttctgaaaagctcctaagtagattgagtaattccaggttctactttcccatgctgtctgctgattgtgtgcttctctgttctttctacagcataatgcactgctacttcattgcaagaagcttcttatgtactgggcccaacttgatgctttacagtttgttcttaggctggaagtgtcagcttttggagtgcaggggcagttgaaatatatctgtcatctaacttggcactatcaccttcccaagcacagtgatattgcctttcacacagtgatggcattgcctctcaggaatactctcccaggctacccctccacagatgctatggtaccatttctccctatgcctcagtttctcctaaagatattaacacctgaatttacctatgaagttgttaaaaaaaatgaattatggcttggactagtacctgtaatagagaagggattttcgatacacattaattattatttcttcaaggtcgacaaccaagataaaagtacgtttccataggttttctccctgcaactcttctcacacacttctacacctgactccaccagaaatctgaaaaaggcagaatgctctttcctgctatcggactcctagatgggagtttcccagcaggcacaagtgccagctgcaggacacaggtgtgccactaatgacctacaggtatgctgagatacaaatttcccctcagctttgtgggaggccaggtgggctctctttaccccctagccttaccttctcacctggtggggttaccccagtgtgcaccagatgtggcttcctgtgtttaccacaacacaaaatattagggaaatgctgttggaattaccttaacactcttctcctagtatctcttctgttgatctttctggcctcaactcaaatctcaccttctccttaaatcctttcctgccttcctcagctagaaggaacaaaagcatgtatgtgatgcaggttaccccaccttcttccataagcttctactgcagttattgtctgatccattgagtagacagttaaacaaatactcagctactgtccttgagacatcacttatatgctattgcgaagtgaaagagaaggattggcagtgggattgatggaactcaccttagagatcatctggtcaaatgatatatagacagaaaggaagtcttatcaaggttaagtggaacttgttcaatgtcacctggagctggaattggaggtccacgattctaataactgatccacagttgtactgcttgcatttctcatgctgtgtctttgctcccaaatataccaggagctcattggtggcccagtcccttcctgattgtcttgtgtctaccacagtgagcctggcccagggccttgcacaaagttggagctcatgagatgtttcctatatgaatctaattggtcacactcaagcattttcctttgctttcatttgggaatcaatcctaaatcattccaaagggatgatagtttcttttctgctcatgatctgtttcaggtctaggatgatacaactgataatgtatttgagcctgtccaggagctgagattggtcactgtagttacagtcaaaaaacggtgatgatcccatcaaaggatggaagaagcagttccaagaagctaattggaaagactgatgagtctaccatttgtgctttcaaacttgagtcgttttactagttctcaaaatttaatttcaataccttctttgaaatgcggacattcagcatccacattgtcccttgggtgaaatgactactcctgtatttcagtgttctaaattatgagcaattaacatcaaggctgtagccttagcaacctgtgcctggcttgggggctttgccccttctgctggttctgttttcttcctcccaaccttcctttgactccctgcagtgcgagccctccagggagggaagaaggaggagaagacaccctgctgcacattacttttctgtactccactgatgctcctttccttttgtgatttaataacttaaacatctgacttgagaacattggagatagtaacaaaagccactttttgaaccttatgagtcctttggagacaactgtcacattttacagtagatgcaattaaaagtaattttgatcatcagtaatagaagcttcacttacaggttctattatttggaatatagttattttttatttcacttttttctagtcatattgtaacattaaacatgcaaatttatgcattctacaattctacactaaactgttactgtgtgccaggcactgcactgctatgttccaggttccctaccttcatggtgtttcagctaggagaatggtggaccgtaagcaaatgattacacagattgttatttaattaaaatagtgagaagtaatgcaagaaaaaatacaagatactcaaggaacctgaaccaaaggggtaaaatctggtatgaagagtcagggaaagttttcccaaagaactagcatttatggtgaggctaaggtgtgaatagaaagtaccagaagaagaggatcaaagagaagttgttcaaagagaatttcgtgatgaaaaatcaagccatgttaagtatttgagatttttttcccctaaaccaccatggaaacctaccgaaggatttttaggaggaaagtgatatgatcctatttgcatctaaaaaataaccctttacctattatgtaaaaaagacagtgtcttgggaaattgtcaaggactatgttaatatcatcttaccttgatagaatagcaaaagagagccaatatctggtgtttggaaaaatataatacaaataaagcataagacaaaaataatattaattttacactggtcttcaaaaccagtgtgggtattactaaatgtctcctcaaagatggtaatgcagatgaaccgatagtaattgggccccagcttctctgagagaatcctaaagatagcaaagcagtgtgaagtaagcttccatatatgcatttgtttttctctgggcattcttttttgttccatcagtttatattccatcaattgcatcaatataatactaattatattagtaattgttgaacctgctaccatgaatcacctctcactcaactcccagcacaaatttcctactcaactttcctctcctccctcttacatggattgattattcttagcccttcattattcccttagaattttagaatcaggttatccagctctatgaaaaccaatgtaaccatttttattttaaaaactgcattgcatttatatattaattcgactagaatttacatctttataatattgactttatctatagacataatttatttctccattgatttaagtgctcattaagtcattcaaaaatatttattgagccataatatgtgccagaaattattctagaaactgttaagcagcggagaataaaagcagaaaaaacactggcttttaggactttatactctaaaaaagtataaaagtgggagaaacaaataattacaaaaaatatacatgttaagaggtgatgagtactgcgaagacgaaaatggtatagaaagggttaaagaacgacgaatactgttttatagaggggtcataataatggtcttcttaaaatcataagtttttttagatttatttatcagtacaatatagttttagatgctagcatagacattgtcttcttttaaagttatggtttttttggctggtgaataaaaatgctattggtttttgaaaattgattttatatccaggaaatttttatatttggttattaaattagtttgcagattctcataacgattgtcattttcaacgtaacacaatttttcttcctttttaatcttccagctgattattatttttcttaagtagggcactgttaggtcctcctgtacaatattctacagaaatggggcaagcaagtattcttgtcttgttcttaaagggatggttctagtgtttcatcattaagaatgatgtctttggtgaatgtttgatggacatattttatcagattaaagattcatagcttgcaaaatatatttctcatgaatgagtgttaaattttcatgtttttagaaaacctaatgagaagataatattgttttacattttccatttccatcatgctatgtggtggaatacattattagattgtctaatgttaagtcatccttgaatgctggtaataaaccctactttgtcatgatttattatttttttccatatattgcttcattttccctgcttctaatttcttcagatttttttttattatactttgagttttagggtacatgtgcacaatgtgcaggttaattacatatgtatacatgtgctatgctggtgcgctgcacccactaacttgtcatctagcattaggtatatctcccaatgctattcctcccccctcccctcaccccacaacagtccccagagtgtgatgttccccttcctgtgtccatatgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatggtgagcattttttcatgtgttttttggctgcataaatgtcttcttttgagaagtgtctgttcacgtccttcacccacttttggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatctgatttgtcaattttggcttttgttaccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaaggaagggatccagtttcagctttttacatatggctagccagttttcccagcaccatttattaaatagggaatcctttccccattgcttgtttttgtcaggtttgtcaaagatcagatagttgtaggtatgtggcgttatttctgagggctctgttctgctccattgatctatgtctctgttttggtaccagtaccatgctgttttggttactgtagacttgtagtatagtttgaagtcaggtagtgtgatgcctccagctttgttcttttggcttaggattgacttggcattgcgggctcttttttggttccataagaactttaaagtagttttttccaattctgggaagaaagtcattggtagcttgatggggatggcattgaatgtataaattaccttgggcagtatggccattttcacgatattgattcttcctactcatgagcatggaatgttcttccatttgtttgtatcctctttaatttcattgagcagtggtttgtagttctccttgaagaggtccttcacgtcccttgtaaggtggattcctaggtattttattctctttgaagcaattgtgaatgggagttcactcatgatttggctctcatttcttcagatttttatagctttattcataaaggcaattggcctataattttcctctctcctactgttcatgttgttatgatatcaaagttacactagcttcataaaatgaattggaaaaattcctttttaaaatctttcctctggaaaatttgtataagatattgtctccttgaagattatcttagagggctttttgaggtgggttttaaataactgatttgattgatctaatagttataattttttcaagttatctattcttgattctgacgttggtaactggtttttttctagtcaattttccatttcattaagttttcaaatttcttggcataaagttggtcatagtattctctaacatttctaaaagttcctaaaatacacatagttatggcttttcatttctaacattttttatctcttttttcttgattctttttatcaaggaaataactaattttaaaatcagcttttggtattatattttttctttattttttctatttcctcccttacttctattttgttttgacttttgctttttgttgcagtttgtcttttttccaactttttgatgtggtctttcattgcatcttgtgggtcatcagttctgagtagcttctaattctcataataatcactgttttaactgttatttaaaagtgtgtttttgaacttccaaatctgtggacttgtttgacattttgtctttgacttatagtgaattttggtcgtagaacattgtctgaagaataccagttatttggattaacagagacttactttgtagccttgtatatagtcaacttttataactattccatgattccttaaaaaaattattctctcctgttgttgaattcatggttccatatgtgttccctagatcaaacccttttgttaattgtgttgttcaaataatcgatattattatatattttgtctgcttgggttatcatttacagaagtgtgttttactttccctctatgattgtgaatttgttgattgctctttctggcaaatatatgctggttcagggtcattatatcttcctggcaaattgttccttatattattatgttggctggaaatgagatcagctgcatgttgtggaaaatcaactagagtggcttagtaaaagaattacatttttctcaagaaataagaaatttagtagtagctcaggactggtcatgctcttcaagttagttttcaaagactcatatccttctaatttcctattccaccactcttgcaatttcattttcaaatttatggtcactgaaaagctcctcttcctccagtatcaacttggcattacacataagaaggtggtagaaggttgaagggcaaaagccctatgctagctaaaactatcaggaaataattacatcaggaaaataatagctttccccaaagtaccatccagtagttttcttttcttctctttttttctttttctttctttctttcttttttattttattttattttttttttatttttttttgagatggagtctccctctgtcacccaggctggagtgcggtggtgtgatctcggcttactgcaacctccacctcctgggttcaagtgattctcctgcctcagcctcctgagaagctggggctacaggcctgcaccaccatgcctggctaatttttgtatttttaggtttcacaatgttggccagactgatctcaaactcctggcctcaagtgatccttctgcattggcctcccaaagggctgggattgcaggcctgaaccaccgtgaccagccccagtagttttccacctatatatttgtgtccagaaatggtcactgatcatccttgatgcaaaagagtctagaaaaatgaatatttttaactgggcccatgggtgccccaaacccaattgaaattccattagtcaggaagaagggaaattgaagaatgttaggctgaaaaattggtagggtatgccatagttgctttaacctgaataatgtttttcaccttgaagaccatgctttccaacattatatgaacttttggttagtacttatcgcatatatatatatttcattgctttcaacattaatgtgttatatcttagaagtgtctgttgtaaataacatagaactagattttaaaatccaatcagtttcatcttttaattgaagatgtaaccatttacatatatcgccatgactgatatatatggatttatttctcccattttatgattttttgctttctagttaatatgttaaatttttgtctcttttatctttcttcttgccatttattggccttttttttttttttttttttttttttttggccatcgtgtctttctttcatcagttatgtcaggaacttgggacagctccattatacctttcttttgctcttctcaaacattccatgagtcaccagtgtctgtaaatctcattttgcacatttaccttgaatctccactagtactatctgggcccaagatactatcatttctctgctaatttttttttcataactttcttattggtgtcctggaatctactcttgctgctactacagaatgacttcactggactagctagagaagttagtgggaaaacaactagcctacattttcctcaacttacccacattgtccaattaaattgagtacttttaacaccaagacctcatgaaaggaaaatgatgtgctcagctttctgacattagcatctaggtaaatggcaatactagtaccgaaatgtagaataccagaaatgaaacatatttagagtggaacatcatgaattcagttttgtgcatagtgaatgtaaggtgtctgtacactatccaaggagtgacgctggtataggctgttagataaatgggcttgaaacttaaagataaatctttacattgaacatattgaaggcttgggaaaggatccttttagatgggtgaagagaaagcagtgcctggtcccaagccctgaaaacttcttacatttaaaggtccaatgaagtagaagcttccgcaaaggaaattgaaaagataaagtcaaaaaggagaggcaagagaatctaacatcatggaatccaggagtaatgagtgttttcacaaggagggagtgatcatttataacagataccactgagaagatgagaatggagaggtgtctgttcagcaacataggggcacattggtgacagcaatttaggtagagcccttggtgcctgtcccagatagaagtgagctgaggaacaagtcaaagatatggaattagagttatttcttttaaataggcttttagagaaatttggccagataagctaagaaaatgacaagcagtagctgggagagggccatgctttcaaggaagaggtttatttaaaaatatagagtatatgtttaaatattaatacagagaattcagtgggaaagaaaagactgaagaatgaggacagcaaagataatccactgagtttctgagaaagcttagtggggtggggtattcatcctacttgataggatgagaagcaacattgaaagaggcataaagatgcaaaaaagaatctcccaacattggaagaaggataaagatgcaaacctctttgtagtgatgttggcagcgagttaaggcagtttctgtctaatgatttttgttttctacatgaagtcagaagcaaagtcattttctgatgatgaataaaggtcagagctttaagaagaaatagtaggcctggtcaatcaatacatagctacattttgttaaatttctagtgttagggacatatttctaatgcccaccaaaaaatccaataatgtgattattttcattctatagataaagaaacaaatgttaaataacttacccaaactcatatggctggggtgtatgccatgcagatggcagagctgggactgaaccccagatttgtttgactttaaaactgacactaatttgaaaaattaaaagagtatgacaaagacaaattatctcctccagtttttcactggctagttggaaattctctgctgtctcttcattggccttattacagttcatgtggatatttaagatcgttttgtgacccagttgaaaactctaacctgcctgagcagaattagttgtcttcaatggttgcatttatttctgataaatgcaaagcatcactaggactaaaatagaatttggggtcagattccttcatggctggggagctctgcagctgtgacagatggatgagggagcaaatgctagagggaaaaaggaaagaaaaaagaatctgtcctaaactgaacctttgttcagacagttaagacttgcctcccagacaggttttatggattgctaggggtctcaatttgtgccctgatgtgtctgagtgagtgtgattttcaggcatccagacccctcctcccaggcccaccccgcacatattctgccttcacttccttgcacagtgaaacgctccattgactgcaaggcttatgaaatgaaaggctctgataatggagtgtaagcatttttgtcttcatgattgtggaaaaaaaaaagcgatgaaattactaagaaatcctcaagatggggtggggaaatgggaacaaatgattcgttgggaaaataaatgcttcagtctaaaaaaatccaagatggaataaaagatgtattcccctcccaatttatagaggagagcaattttttggtattttctcagccgaaaggaagaaaaccttaaatttcttcttttctgtctttatgagtctaaactatttttaagactttagagtacatcaggttctgatatcgtgtgcattttgtttctttaactgtagttggtattttatatggacttctgagcaaactgaattggaattctgcaaggtcaggggactgtttcgtttgtctttgctcaccacgaagcctaacacctcctgccatgcctgacattgtataggtgacaatttttaaaaaaataaatgaatgaattagcgaattaaactttcttctcagagtattttcaccaacagttttcactggcctctggttctcattactttctctttactggcattttcaggggatttcatacctgttttaattttgctttttctagttgctgtagttattgttttagttaccaaaaatgacttaaaattgtgaaatatgtgagcaggatcgggtcgtatttactgttgaaatgtatcaggcttctcccttccaatcctgctctagccacaatctgtaaggtcagtactatgccacactggtggcccttgggcctctaatttgggacactgatactgatctctgacccctgttctgctgatgtaccctatagccttgtaattgcccttgaagaaagtcctacttgctttggttacttacccttcaaggtactgaaatgtgactgtggcccagctgtcctccaggtgctcccatctgaccacatgactctccaatcctggctcccatgattcgttgctgctcagtcatgaggacatgttgacacctcatcttggtctctctatggctagcaatttctctaagctctgacatacctgggttttgggccttcttctgcaaatggatcactctctcatacagactattattctaacctcccgaattcccaggtcctggcccctttctacctatgcagtcttaatctaacaatctgctaatatgttggtgtatgtacttgaggatttttttcaatacttagacataaacataactatgcacacttattttcgataaacctgaggtcactctatgcatacttctttgtaatctgatgtttttctcttaataaaactcttaatagagttaattaatagacatccacactaattaatggacatccacatctattatagacatccatattaattaatagacatccacattaattaatagacatccacatcttcattttaactcataatcctcctggttattattattccatttcatgtttattactattacatattttaaccaatcctctggtgattaataattgagttgctacagtttttggctttatgctgtgatataaatccacatatatatattttttacattgtccaattatttcctcaagtcctagaaatagaaatttggggccaaatgttatatatattttatagcttctgatcatatattgatacaactggtctaggtttactattgtatagttccacaaattgtgttcaagtgccagattcaattctccctcataaacatttattattattattgaattagctttaatatattataaatttttgtgaataaatatacacatagtaaacttatgacttatagatattatacctgattctcgtggatattccatgctctggtgtatacgaaggtataaagaagacagcaaatgccctcttatcattacccttctttccaggagaccatcttttttttttttttttttttttttttcgagacggagcctcgctctgtcacccaggctggagtgcagtggcgcaatctcggctcactgcaagctccgcctcccgggttcacgccattctcctgcctcagcctcccgagtagctggaactacaggcgcccgccactacgcccggctaatttttttttttttttttggtatttttagtagagacggggtttcaccgtggtctcgatctcctgacctcgtgatccgccctcctcggcctcccagagtgctgggattagaggcgtgagccaccgcgcccggccttccaggagaccatctttatagctgctttcatttttgctttagttgttatagttatcctgttatttagtgtagacctccaaggtttttttctgttatcataatttcattgcttgctaatgtaatagacgaaatatggcatggtgattttgacatgatttgtgtttattataacattaatgcagttaaacatctttttgtaagtttatttaagccatttccttttcttcttttgtgacttgcctgcttcttttttactcatttttgtattggggtttatgttttttcttagtaatttttaagatctctttgaaattaaaggtgtcaggttttgtttgctttttgatattgctgtgtttattcagatacaaaatgtttttccactggaatttctgcatttggatttaggcttagaatgctcctccaacccacaccctcattcctgagtttataaaaactgcctatattaacaataacaacaacattaagaactaacatttcctaagttaacactaaccatttgccaggcccttctaagagccttgtatatgatctcctttattcatcacaaaaaccccatgaggcacatactgttataactcattttacaaaagaagaaactgaaacacaaatgtttaagtgacttagtcacatagagagtggcagaccctgcaatctaacctaggtagtctgactccagaggccacactctaaattgtgatatctgctttaaaacttgaatccatttggaattaatttggtaaaagtataagctaatgattttaactaatttttcccaaatactaagttatctcaatccatctgaataaagtaacatttcctaaactaccaatattagtgtattacccatactcatatttttagttttttgtcagtctgcacatttaagctttatatatcactaaactgctttttaatagccagatctgacatttggataatggggttttgttgttgttgttgttttactttaagttctgggatacatgtgcagaatgtgcaggtctgttacttaggtatacatgtgctgtggtggtttgctgcatctgtcaacccatcatctaggttttaagccccacatgcattaggtatttgtcctaatgctctccctccccttgcccccatcccctgacaggccctggtgtgtgatattcccctccctgtgtccatgtgttctcattgttcaactcccaattatgagtgagaacatgcagtgtttggttttctgttcctgtgttagttttctgagaatgatggcttccagcttcacccatgtccctgcaaaggacacgaactcatcttttttatggctgtgtagtattccatggtgtatatgtgccacattttctttattcagtctatcattgatgggcatttgggttggttccaagtctttgctattgtgaatattgctgcaatgaacatacgtgtgcatgtgtctatatataaagaaatgtgccacatttttttatccagtctgtcattgatgggcatttgggtggttctaagtctttgccatggtgaatagtgctgcaacaaacatatgtgtgcatgtgtctttctagtagagtgatttataatcctttgggtatatatccagtaatgggattgcaagatcaaatggtatttgtggttctaaaaccttgaggaattgccaccctgtcttccacaatggttgaactaatttacactcccatcaacagtgtaaaagcattcctatttctccacatcctctccagcatctgttgtttcctgactttttaataaccaacattctaactggcgtgagatggtatctcactgtggttttaatttgcatttctctaatgatgatgagctttttttccacatttattggcagcataaatgtcttcttttgagaagtgtctgttcgtattatttgcccactttttgatggtgttgtttgttttttttttcttgtaaatttgtttaagttccttgtagattctagatattagacctttgtcagataggtagattgcaaaaaatttctcccattctgtaggttgcctattcactctgatgatagtttctttggctgtgtaaaagctctttagtttaattatattccatttgtcagttttggcttttgttacaattgcttttggtgttttagtcatgaagtctttgcccatgcctatgtcccgaatggtattgtctacgttttcttctggggtttttatggttttgggttttacatttgtctttaatccatctaagttaatttttgtgtaaggtgtaaggaagtgatccagtttctgttttctgcatatggctagccagttctccggataatgggtttttttttaaggatatataggcttgttaacttgttaactttatttctacatacacaccacacacacacacacaaacacacacacacacacacacacacacacaaagacatcacataaattcaacacataaattttaaaaatttgcagttctttttttctctttttattctcaaattttctttattttatttttccataagtttttggggtacaggtgatatctggttacatgagtaagttgtttaacggtgatttgtgagattttggtgcactcatcacacatgcagtatacacggcaccatatttttagtcttctatcgctcaccccactcccactcttccccccaagtccccaaagtccgttgtatcattcttatgcctttacgtcctcatagcttagctcccacatatcagtgagaacatctgatgcttggctttccattcctgagttactttacttagaatgatagtctccagtctcatccaggtctctgcaaatgttaagtgatgcatctgctgataaagctcttgaaaagtatttcatagtggcattgctgaaacaagtcacttctagcagtattttcgtcttcatctgatttgtgtcatttataagatttttttaaagactgtttccttttgcccctattttgaagccagatacaacagagtatgcaatgtatagggatttaaagtagattagtggttaggactagggatgggaatagagagtgactgtaaatgggcatgaagttcctttctaaggtgatggtaatgtttcaaaattagactgtgatgatggttggaaaattcggtgagcatactaaaatttatgatattttacacctaaaataggtagattttatgggatataaattatgtctcaacaaaccaatgttttataaaagcaaccctatgctcactcaaaagaaaacacatgcacaaggaaggtgggatattgaaaagtgctgatattaaccatgaagaataagcctcaaaaatgttgtcaagttgggataaatatggagataattagaatttgagagctattcactgttgtcctcaaacagacattatcttacaataagcatgttgactatgggatctattgtgaatgaaaggaaatgttgggaatgtattgttaaaaaatatgttactaaagtcatatgtgattggggtttgaatagaatttttagttgttagagaatagaaatccctttgtaacatctaagtatgtttccagtttctgtgcatttgtattccatatttttgagatacttatgtaccaacatagtagattttactgtatactttgatagacttttgtactttgtgtttttccattgatcttcacttttctgatagcagtaggctgatattatcattaaagccgcttaataatacactttactatccagtaagataaattcctcatcttattcttataaatgttaaagagattggttgtttcattcatttgatcttgcaaataaacctttaaatcaattagaaaatatatttaaaataaatagtggtcttgctctggaatttacttatatataattttgatatgaatgaacatctttacaacatgaaatgtttccttccaggagcatagactatctccacttactctattcttttaaaataatcatctaataaaattttgtaaactttaaaaatctagattcataatttttaagattttttctatgtacattatatttttgctgccattgagagtgggatttttttatttcttaaatctcttatatatagaaaaaaagctgtctttatattgaggtatagtttacatttaataaaatgcatacatcttaagtgctcagtttaatgagttttgacatttgcgttcacacatataaccaccatctaaaacaaggccaccatctaaaacaaggtatagagcattttcatcaccctagaaagttttctcatgccctgttccagtcagtacccccaaaacagccactttctgacttctatcactgtgatttcctcttcttgcacttcatattttaatgtgtgtggaggattcttttgttcagcgtaatgcctttgatgttcatctatgctgtgagtgtatcagtagtttgttcctttttcgttgttaaataatattaccctgtatgaatatagcagaatttgtttatccatttctttgctctttaacatttgggttgtttcaaattttttgtttgttttcttgctaatatgaatacagctgctatgatgattcttgtataagtctatgtgtggacttatgtttctatttctcttgggtaaatacctaggagtagaattccttgatcataggatatatctatgtttgtaagaaacacaaatatcttttcaaagtggttgttattatattacattcctaccagcagtgatgtgagttccagttgcttcacatctctgccaacatttgatgttgtcatcttttttatttcaaccattctgatgatggcatttcgttgtggcttttctgtatgactaatgatgagcaccatattgtgtatcttcttttattaaatttatgtggggtttttttgctcatttcttttctctctctcgctctgtgtgtttgttttttgagattagatctcacatgtcacccaggctgaagtgcagtggcacaatctcagcttgctgtaacctccacatcccaggcttaagtgatcctcctatctcagcctccagagtagctggaactacagtcatgcaccacaatccttagctaattttaaaattttttatgaagatgaggtctcattacattgcccaggcaggtgatttcttaaaattcttttgtagaggggggaatctctctatgttgcccagactggtcttgaattcttggcttcaagcactccttttttccccatttttagttgtgttgtttatctttggatttgtgatttgtaggaattctttatttttatatacttattcttagccactggtctcattagtttcaatagttcttcacttggttatattggatttccagctaagcaattatatgctctttgaaaaattatatatttgcttctcttttgctgtaattttaccttttacgtgttttattattttatggcataagctggaacctcccaaactgttgagtaattgtggtgacagccgatactgatcctgaatataatgataatgttattagtgttacagtattaggttttatatttatttttattaggaatggatgctaaatattccccaatatttttctattgagatgtttgcataatttttctccttcagttcattaatatgatttattatattcctagtttactaattttgaaatatccatgcctctgggataaatcctacttggccgacgtgtattcttaatactgatagattttattcattaatacattatatagtattttaaaattatattcacataagaattgacctatagttttgtttgcatcctttgttgttattgttttgatggatatgcttccttgttttgtgcatctttgtctgatactggtttcagggttatactaaacttaatagaagagttggagcattgttattattttctcctctggaatgtattttttaatacatcagctacacgtgttattttatcattcccattcccctatttcacccttgagagatttttccctacctcacctctcctcttcctatattgttatactggcatatgtcgagctctggaggttcctaaggctccctgttttacctgctctggaaactgctcttggttcccctgctgccaagcataggctttgtctctgttccagaggccctgagttgttcagatttgtattttattttggaataagccctcatgaactaagctgcagggtgtacctagggcagcaataaacacagttctactggccctgagccatgtaataggttgaacatatgaaactccccatatcccaccagtttcaacctacaaaaatggcagtttcacataactcagaataatgcctggactccctcctccagatgtttggaagcacctggagggtgggaaagccttaaattttctctgttagagaccttggaaggagatgcctgcaattgttgtaattgggacacttcgtttgggggaaaggcttcctgatgaacatgtccaacattctttttacatttttctagattgtcctagagagttcttttattattattattatactttaagttttggggtacatgtgcagaacatgcaggtttgttacataggtatacatttgccatggtggtttcctgcacccatcaacccatcatctacattaggtatttctcccaatgctatccctccccttgctccacacccccaacaggccctggtgtgtgatgttcccctccctgtgcccatatgttctcattgttcaactcccacttatgagtgagaatatgccgtgtttggttttctgttcctttgttagtttgctgagaatgatggtttccagcttcatccctgtccctgcaaaggacatgaactcattcttttttatggatatgtgacattccatggtgtatatgtgccacattttctttattcagtctatcattatgggcatttggttgtttccaagtctttgctattgtggatagtgctgcaacaaacatacgtgtgcatgtgtctttctagtagaatgatttataatccactgggtatatacccagtaatgggatttaaagatcaaatggtatttctagttctagatccttgaggaattgccacactgtcttccacaatggttgaactaatttacattcccaccaacagagtaaaagcgttcctatttctccacatcctctccaccatctgttgcttcctgactttttaatgattgccattctaactggcacaagatggtatctcattgtggttttgattttcttttctcgaatgaccaatgatgatgcgctttttgccatatgtttcttggccacataaatgtcttcttttgagaagtgtctgttcatatccttcacccacttttcgatggggttgattgtttttttcttgtaaatttgtttaagttccttgtagattctggatattagccctttgtcagatggatagattgcaaaaattttctcccattctgtaggttgcctgttcactctgatgatagtttctttccctgtgcagaatctctttagtttaattagatttgatttgtcaagtttagcttttgttgccattgctttcggtgttttagtcatgaagtctttgcccatgcctatgtcctgaattattgcctaggtttccttttagggtttttatggttttaggtcttacgtttaagtctttaatccatcttgagttaatttttgtataaggtgtaaggaaggggtccagtctcagttttctgcatatggctagccagttttgccaacaccatttattaaatagggaatcctttccccattacttgcttttgtcagatttgtcaaagatcagatggttgtagatgtgtggtgttatttctgaggcctctgttctgttctattggtctatgtatcttttggtaccagtaccatgctgttttggttactatagccttgtgatgtagtttgaaatcaggtagcgtgatgcctccagctttgttctttttgtttaggattgtcttggctatatgggctcttttttagtgccatatgaaatttaaagtagtttttctaatcctgtgaagaaagtcaatagtagcttgatggggatggcattgaatctctaaattactttgggcagtatggccattttcatgatattgattcttcatatccatgagcatagaatgtttttccatttgtttgtgtcctctcttatttccttgagcagtggtttgtagttctccctgaagaggtccttcacatcccttgtaagttggattcctaggtattttgttctctttgtagcaattgtgaatgggagttcactcatgatttggctctgtttgtctattattggtgtatatgaatgcttgtgatttttgcacattgattttgtatcctgagactttgctgaagtttcttatcagcttaaggagttttggggctgagatgatggggtttctccactctagccacactagcctccatgctgttgctcagggttgttttccctgcctgaaccacttccccctagatattcacatggcctgctccctcacttccttcaggtctcctcttagatcttcgaggtcttccctgaccatcctgcttaaaattttatttctttctgctgggtgctgtctcccttttctaaaagtaacagttttcaccatttaatatacaatatagtttacttatttaatatgttaactgtctgagttctagaatggcaacttgcatgacaactctactatgtcacacattcttattcacctctgctttgtattcccagcacctagtataatgcatggtacatggtagatattcaacaaatatatttaataaatgaatgaaaaattttaaagtgaaaacctacctgtttctctttctctctctctccctcttctctttctctctttttctctttatctcttcctttctctctctctatctctctttctctctccctctttctttccttccttccttccttccttcctcctcccctcccctctcctctcctctcctctcctttcttcagcatgtccagattctccccaacctcctacaaagctgccttagcttgtattcccagtaaatgagagcaatgcctttgtggaaagaagagcagattcctacacaccatagactaagtcatggaatttcccaagtcatcagggctactctggtgccctagtttgtcagccaaaccatctcagcacatggaatgaccttgggctgttaccaagaagtggattccctgtagcagttggcttactctttctagaaaggcctgttagtctctaatatagcattgggtagagcaaactgcagacctctgctacatcccgggaattgaaatgggaggcttgttctaaaattctcataggaatttttaacacactctaaaaatgtccacctttgaatgaagatttagggtcagagagagcatacagggatggaaagtatcttccagactgatttttgacactggtgaactttgtgaccatgggcaagctgttcaacctctctgatgatatgtgatcattccctgcagcccaaagccattccatttaaaaaggatatcttatttgttttctttccagtgtaattatgtccacaacatagaaaatgcctctagcatgtttgtatctcctttatctagtatgtagataacaacataagagtatctttgaatgagagttgagtggtggagagaagtccctgatgtcaactgtccctgatcaacctattgttcccttcctgtagagactactgctattcatccattgatgtactgagttcatgaattatggacccactctatgccaggcactgttctaggaggtgagggtacaacccagagaattagttaacatatgtatttcagacactgtgctaaacactttacatatatcagtttatttaactagaaagagagtgagagagaattattattgtctctatttgaagcacatctgagaagtcttgattattcctaagctaccttttattggaacaaagccttttgtttccctcaagagttttaggaaattgcactggacccagagggaagtgttcttcaatgcctgtgcttggaggaaaggcagatcctcttttactaaagcatcatttgccctatttcacaagcaggattcagtcaaggtagcttctctttctttatttttttttctttttcccaccagcttcaaacgcaaaaataagttcctgctgataaaaggtgagaggcaaggccatctcttggcccttccacaagggtggaaacattgcatggaaaagggaagaatctggagacacttaattcccagtccagctcctccagtttccctcatatctccgccacacaagagaagagaatatggccacttccctctttactagccactaagagcttcttagtctatgcatgggctccccacttgggaatggtataggctctgtagtcagactgcctggttggggcatggcttcagcactaactagctatgtgagcttggacaagttaattaacctctgactctggattcttctctataaaaaggccatagcccaaggtaaaagtgccaaaaggaagaagatatagctcctgccttcagcatctcagagtggcaaatatatcaaattccatgtggtaataggaacataggcagagaattaccaaagcagagagcacaggctaggagaggccctgaagattgcacagagaggtctgggtcttcaaagatacaaaaaaaaaaaaaattaccagcagagaagtgagcaggagttattcaggaagaaacagcacacaaagaaatgaaagagaaggtttgcgatgagtcagaaggtgggtgtgggggttaagaatagtttagcctgattggagaattgagtatgttaggagaaagaactgctggaaaagtcattttttatataatatgctaaggaatttggaatttaacctaagagcacccaatatccatggaacgatttaagctaggagtgaaataatcagatctgtgtttacacagaggatgcattggaagaggtaaattgctcctgagtaatctttcagagactgaaggaaaagagttgtaatcagcacacattttacagttagaatgaacatgacttggtgacccaagtactaagctctaagagttacatggtaattgtgatggaggaacagttgatggagatggaagagggatgagggaggtgcatagtgctcctctccagggaaacatttaaaaaaaaaaaagaaaaaaaatcctatgtcctatgagtatccatggagcaagtctccacccatggtagaataaaatattgcctttttctttatgattgttcatactactgagaatgttggcttaattcacttgctgccatgcttctctttagaaggcatctttactagagaatctcatcatcccgtctcccataaactgcaggaattcttagttttgatgggaaatttcaggatgacgaagatgctgagaatgcaaggtcaattcaaaattatttccagctcatcttaatgtgttcttttcttcaaaagccgataaaacacactgtggcagtcagagctagcaaacaacactcagttctaaggatgctttgatattcccacagcttttaaataaaaaacaatttttcatctccagttacttttgggttttttcttattgagtattggtagatttgtaaaaaaatgaaaataaaaaagtcttttcagaataggttcttaacatcaaattaaatgctaaagcctttctgtagccctttaactttgaaaactgctgtctttgttttagccaaggactctccttgactagacatgctccctggggaaataggcagagttttaaaaatcatgtttgaatttcaaagtatctattaagaaagcatgttagaaaaaataagaggtttccagtaccccaaattcctgtgtcaggtgcaccaaggattgaaaggcttcacctcctttttcccatatccccttttaaagtacatgtgttcctaggatgctgaattaagcattattattcaacagccctcatcatttctggtctctcagtctccgtatcttcccctcagatacaatgcatactccaaacagattgtggttttagactgtgatagagaagaatattctaaatcttcttgtgtcttctccttgttggtcttcgttctaatcattggaatcatgaagaagtttagtttctcttctgtgtgactgacacccctccaaatttgtgctgacaggaatcttgtgtttctttaatgtttaatttaaatcttaatagttcctcattactccttatgtaatcctgaccctctctcatggtggttactcaactgtctttcatctgcttacatatctctaaaattgagattaccatccaaaaggcaggcaataacaaatgctggcaaggatgtggagaaaagggaatgcttgtgcactgttgatgggaatgtaagttagtataaccactatggagagcagtttggaggttcttcaaaaagctaaaaattgagctaccatatgatccagcagtcccactgctgggtatatacccaaaagaaagtaactcaaaatattaaagagatatctgcactcttatgtttgttgcagcactgtttataatagctaagatttggaaacaacctaagtgtctatcgagagatgaatggataaagaaaatgtggtacatatacacaatggagtactactcagccataaaaaggaatgagatcctgtcatttgcaacaacacagatggaactggggatcattatgttcagtgaattaagccaggcacagaaagacaaacatcatatgttcttatttgtgggatctaaaaatcaaaatacttgaactcatggagatagaaagtggaagggtggaaaggtgggaagggtagtgaggggctgggggagtgtggggatgggtaatgggcacaaaaaaattagaatgaataagacctactattcgatagcaccatagggtgactatagtcaataacttaatgtacatttttaaataacttaaaaagtataattggattatttgtgactcaaaggataaggggatggataccttatttgaggggatggatacctcattttccatgatgtgcttatttcacattgcattcctgtatcaaaacctctcaggcaccccataagaatatatacctactttgcacccaccaaaatttacaaaaataaaaaatatataagtagcacagcaaaaaataaaaacagaaaataaaaaaataaaattaagatattcagaaaagaattaatgtctctagtgggttatggctggtgcacatccctttctgtccagactatacctctactgatacagcctaaagcaaaatgagtttctggtagccatatcgcattttgattcaaaataagactaaaccataaagccttttattttcacatgcattaggttgcatctacttcagatgttgtatcattgactttttaggccctcagataatttatcttgatacatttatattgttaggccttattgatcttacctatctgtcagaatctttatggatcttgattctgtactccagtgtacttattatgcctagtgtgccataccgaaattctatttctccttctaaacaattgataaaattacagaactggataatacttaggttgttgaatcattcgtggcatgctttagctatggttgtcaaactagattataaattcacctcattttactatcatctggtctaaatctatccagatcatccataagggtatcaggagagagcttaccagatgttgtgtcaaggtccacatttactgtgcctacaacagctccctaatatgtgagtccaatagcctaagttaaaaaaaaggaggtgatattggtctggtatcatctgcttttaatgaatctattgggacacaatgatttttaggggttcagaaaccatactttttaatcaatcccagtagcatgcatgagatgagcactgagcttacttttccaagaaaaggactgagctctttacatttacctatatggtttccctctctgccagttagggtccttggccactgccctgtggtgaagctctgccctgtcatcctagacagtgggcccctatggagcagaaagaagccagttgcctctagtactgagaaaagcagagtacctggtaagccctcagtgagatattgttggctaagtttgtcacagaagagagtgtctgccaaatgtaccacaccttccctgactgtttgggacgtgttttgaaatgtgaaagactcaaatcccagcagtgcaaagctggacatcatgtcattcaagacaagctagagctgtctctttttttacaggaaggcacagaggttactgagattgagcaattattacacttactgtcattaaattcttctttgtgttattgttattatcaatcccatctgccactgcagctctaggatacaagcagcttcctacgtggtggatatgagataggagccttccagccactggtactccagaagcctttggaggaggggaatcccaatcatgtggggaaggaaggaactataatgtctcatcatctccacaagcagaaccaagccttttctgaagccttttgtgggcactcacctgtgtgtcagtgcatcagcccagactgggaagcccagactcagagtcatgttgcagtgtaggcatgaggatatgtaaacaagcaactgaggctcccttctatgctgtgcaactcgtgtatgacataggatcctatgatattagcttgtcatagcagccatcctgcccaatggtctcacttctccttttgccttcattgttctacagtagcgcatgtgagagagatggtggtatcttaagatagggtagcactatggaaaaggagaaaattggacaaattctagatatttttggaagtataaatgtcatgacttgcagatgtgggaagctgagagaagaggggcaatagagatatgatgactaccagatttttagctttagccactgagaggaattttttttttccaaactgagattcatcttgccttcaggcaacttaggtaggaaggctgtgagcaagggaggaaaaattagctccattttcaaaatattaatagtgagttgcttatttgatcactaaataagaaaacacttgtatatatgagtctatggtgcatggaagagatataaatgttggagtcattcacatataaatggcatgttaaaccagggaactggagaagatcagatatgatggcgatgtgaatgcttttcgttgaccgtaaggagctttgcacataatgtgatgttgttatcttgtccattcctagctgaacatatcattggccaaagaaaattattttcaaattggggctagtcctaggtaattagacctggaagcatttgagggagtaattcagaaagagaaaaggagtgggctgatcccagacccttcccatcccatggccctgtgaggctgcggagcttgccggagccccagcaccagctcagaaattgtcatcctccaggcacacttccaattcaattaatcatgttaatatctataagtaaagtgcagtcaacagttactttaacagtgaatgctaattattagtaggatccatcgcttaagaaggactttttgccaatcttgtcatgtctggggaaaatatcaggaatagagttggcatttctgagaaaataggatgatcaaactattaacgtcgtccatgttataggtggacccggcttggaccatcagtgtgattattacaggtgaagattaaggacacttgagagaaatgttacaattaagatttcctctccccttgctaaataaatggtttcttgctgttgcctctcacaatggtttttgctttagaaagaggctctgtaagtacaggatttctcagttagccagtagtactaggaaatatggtggctgggaaggagggaagggaaaccagatgtccccagagagcccggtggctcactggacatttgatccaaagaccccaggaagctgggctactgagggtgcaacacatatccaaggaccctcgaaactttccttcatttgcacatcaattcattagtgaaagaaacagggactgggccactcctaagttgcagtcactggggagaggtgggtaagtgggccttccccttgaaaagtacccagactggtggaagtgacaaatgtgtaatcaagtgtaataacagctacgtcatgttcagtatttactgcataaagacattttctcatttagcctttttatcaaccttatgctgtagatattagtttccttttccaaaggaggagaatgcgaacagaaaattgagaaactgagaaattacatagtttatttcacgttgcagaatgattaaatgaggggtcaagacttgaattcagcttcagtcccttgcactatatgtctaggctgcacgagtttttaaatacaagtgaagtcatcttttgggttagacttctaacctcaattccctgtcttcagaaatactttcagctactttgtttctttttaaatatgcttccatattttatataaaatgttagatttgacttgatttttaattttatatttctattgaattttattatggaagatgaagatttagctcttaaattcactagccacacacacacacacacacacacacacacaccctcacaccttacttccctctcccattttctcaaaatcgttatacacttgtggagataattattcatgtttgtatcattattgttatgtaaacatgatgtatagctgaaccatgtatgtctctgtggttacattcttttttcctcccaggagttggtaatttgtatctctaacctgaatcttcccctgatttccattctcttatatctaattggctactcagcatctgcatttggatgtctaataggcatctcacaattaatgtatgtgaaactgagttcttgatctctcccatagtccagtacttctccccctccacttggaaatgggtgttaatggcaattccatctctccacttgctcaggcaaaaaattctggaattgtccttgactcttctctatcacttcttccattagaaaatcctattgctttatcttcaaaatgtgatgacctctcaccacctgcactgctttctttggaacaagccatgtcacctctcaccaggttcactgaagtaaccttctaactgatggccctgatctccccagactattcttaacactgctgtgggctatcctgtaatagtgctacttgagctgtgttgtgctacttttctacttcaatctttgtaatgaattccattcccactcagagcacaagcaaaaatcctttcatagtttacatgatctgatccaccacagcctctctgacctcatcattttcaatctctttgtttctcactatactccagctacacctgccttgcccttcctcaaatgcagaaggctactctctcacctcagggcatctgtgcttgctcctctgtttggaattttccccaattaactgcatggcttgcttccttacctcatttctccaggtccttattcaaaagtcactctctcataatgcctttcctgacctccctatttaatatattatttaactccccactacttaactccctttcctgcttatttcttcccattgcattacatatgtgtattatatgtatacttctgtatatgtgtgtatatgtgtgcatgtgtgtataatttattttgctcattgtctgtcttcacacacaagaaatataagctccatgagagtaaataatttttgcctgtttggttcactgacagattcccagaacccagagtaccaggtactctggtacaaataattgctttctgtaaatgtttgttgaatgaagaatagaggaatgaactatattgtttttgtttgctctgtgtgtgtgtgtgtgtgtgtgtgtgtgtgcgtgtgtgtccatgcagctaattcatcccaaactctgtcagacatttaagtctcttagtgaatacatcaggtttcatttctttctatagaggacaacattttaggacaaagagcatgcctggcagtggtgtaggaaggcaaatgaaaagaatcagattgaaaaactgcctgctgggtactatgcctattacctgggtgacaagataatctgtataccaaatccccatgatacacaatttacctatataacaaacctgcacatgtacccctgaaccttaaaaaaagtttaaaaaaatcaatacataaagcaaatatctatatgcatgagtcagtttctgggctctctgtgcagctccactggtttatttaccctgcacaaatgctacactagtccagtccatcctggacactagttcagttgcattctcataagttttcctatccaggagagcaaatgtttctactttgctttttatcaaaagaattttggttattcttggcactttgcatgtccaagtaaaaattagaatcagtctgtcaagttggaatctgaccgtaattatatttagcctgtagataagtctgggaaatatcttcacaatattgagtcttccaactcataaacatggagtattgctctatttatttagactttccttaactttgctcaataatatttttatctttttctgcagaaaactattggactttttggtaagtgtattacaaggtatttcatatttttaaggcaggtgtgaggttttttctatttttatttgtttaacctgttttttttctggtatataaaaaagcaatttaaaccctggaagaaaacctaggcaatgccattcagtacataggcatgggcagggacttcatgtctaaaacaccaaaagaaatggcaacaaaagccaaaattgacaaataggatctaattaaactaaagagcttctgcacagcaaaagaaactaccatcagagtgaacagtcaacctacagaatgggagaaaatttttgcaatctactcatctgacaaagggctaatatccagaatctacaatgaactcgaacaaatttacaagaaaaaaaaaaacaaccccatcaaaaagtgggtgaaggatatgaacagacacttctcaaaagaagacatttatgcagccaaaagacacatgaaaatatgctcatcatcactggccatcacagaaatgcaaatcaaaaccactatgagataccagctcacaccagttagaatggcgatcattaaaatgtcaggaaacaacaggtgctggagaggatgtggagaaataggaacacttttacactgttggtgggactgtaaactagttcaaccattgtggaagtcagtgtggcgattccttagggatcttgaactagaaataccatttgacccagcaatcccattactgggtatatacccaaaggattataaatcatgctgctgtaaagacacatgtacacgtatgtttattgcggcactattcacaatagcaaagacttggaaccaatccacatgtccaacaatgatagactggattaagaaaatgtggcacatatacaccatggaatactatgcagccataaaaaatgatgagttcatgtcctttgtagggacatggatgaagctgtaaaccatcattctcagcaaactatcgcaaggacaaaaaaccaaacactgcgtgttctcactcataggttggaattgaacaatgagaacacatggacacaagaaggggaacatcacacaccagggcctgttgtggggtgtggtggggggatagaagcggggagggatagcattaggagatatacctaatgttaaatgacgagttaatgggtgcagcataccaacatggtacaagtatgcatatgtaactaacctgcccattgtgcacatgtaccctaaaacttaaagtataataaaaaaaaagaactatgaggaataaccctaaacaaaaataataaaataaaatgtgcttcttgaaaataaaataaaaaaggcaatttatttttgtttcctgagcttgtatccactctattaatcatcatcagtaaacatgcttataaattttaataatttatctgtagttgtcggaatttattttgcatatcatgtcgtctaacgataatgacagaatgaattctttgtgccaaaactttgtaccttttccttctttttcattccttatttcactaagacctcaaatacaatgttcaatagaagagatgatgtaccttattcctaacattaattaaaaagctttcaacatttcactattaaatacaccattgctgtagtcttgtttttagatgctctctttaagaaaattccctttccatatctggtttggatgcctgatttcatcacattttctacattcatttagatcaactataagttatctctttattctcttatgggcagttaagttgtttaaatttcatatgtttaatcaaccatgtaaacgtgaaaacatgtatgtttgtaattcattgtatttttctggattcagttttacattttgtctaatttattaaaatctcaagtcataactgagattgaactgtaattttgcctttcttgtaatggccttttcagcttttagtacccaaaatattatgtctaaaaactatgaattggggaatattccctccttgtgtatttttggaaatatttgcacatattgcgtttacttcttccctaaatgtttaatagaattcaccagtgaacccaactgcacctgaaattttctttatggtaaggtttttaattacggattcagtttacttaatgagacatagacattcagagtcagtatttctcatatctagtttatgagttttgtgttttaaagaactagtccatttaatccaaattttaaaatctatgggtataaagttgtttgtaaaattcttttatctttcaatgcctttaggatgtgaagtggtgttgtattttcaaccatgacatggttattcgtgcctttttttctctcctgcccctttcctttttctgtcttgaaagagggctatttttatttgcctttcaaaagctaacttttggctcgttaatcttccctaaatatacttattttctattcattattttctgttcttgtatttatttccttcattctacttaatttgttgttatgttctagttctttagataaatgatttgatcactgataattggccttattttgggctattttatgcatttaaagctaaaatatttctcaatataattttttagcattttaaatgttttgaaatttattatttttattatcatagagtccaatgtatatctgtttttcatcctgttatttattttgacccatgttttatttagaaatattttcaaatgtatggaaacattctagttatcttttcattatagatttcgagtttaattgcgttatgatcattcctcatctgatctaacatctttgccagccctactgttaactaacctccttccagaatgtttttcatgacatcagctttggtctccgggtgaaaatgtgtggtggttgggttcacaagcatatggaccacaaccacatctccccttcccagtccaggaaaatatgtgtgaaaaggaaattgaagtgaggacattgtgtggttgtttaataaagggttaagtcactaggcttggtgtgcttgaacctgcacattctaaagaaagtaccagctctttactggttcctgagagataatttctaaacccttagaatattctgcctaagagttctttatatgacagaacttgggccaatacagaaaactgtaactctgaatataacagcatttctgggtcctgtgagtccttctagtgaattattgaacctgaggatggtactggggacccctgacacaatggtactaaaaaaatattgaggagactggggtatcaaaagtgtattaatttcttgcccaccttgtgtgaccttctgtaaagccaatatttaataagtttgctgatataaatatacaagtagtattaaagaataattcacgaggacttccagttaaatccatcaggtgaaaaacataagatgctacccccattatctcttgagaactcccccataaaatgagagtagatgaactacaaaaggaataagcaatagaagactttttgctttaaccattcagttataaatgcaattaatttatattgtaggacattatgaatgtcctacaatcttaggcaaaccaacatcacaaaagacaaggtacaaaataaaaatatatatcaactcatcactgaataaaaagagactaaagcgagaagaaagtattctaattaacatctatcactaaggaccaagcgagatcagtgaaaacaagttatccagataacttttggagaaatttcagaaggcataagtacaaagtaaaagtatgaaaagacaatcttaaaacctgcttgggaggaaaaaaaaacctacataagaatggcatcaaacatttcaactgaaacatgaaatacaagaagactttgtgatgtaaaatgattctgaaatacaataattttaacctaaactctatgcccagccaactttctgttaagaattagagcacaataaatactaatttttattatactttaagttctaggatacatgtgcacaacgtgcaggtttgttacacaggtatacgtgtgccatgtgggtttgccgcacccatcaactcgtcatttacattaggtatttctcctactgctatccctcccccagctccccacctcccaacaggccccagtgtgtgatgttccccaccctgtatccatgtgttctcattgttcaactcccacttatgagtgagaacatgcggtgtttggttttctgtccttgcaatagtggtggtttccagcttcatccatgtccctgaaaaggacatgaactcatccttttttacagctgcatagtattccactgtgtataaatattattttaactacctgtgaaactcactggaattttttagaagcccttaatgacatactcaagcaaaatgagccatgtgtcatggttttcattttggaaggatagatgatggttttaagaaacggtagcagttacagaaatgagaacattttaaacatggtttaaatgtttattaataatttggctgtgaaacataatggaatagtaagaaaccatatgtaaaataaagaagcataataaattctagaggaagatttggaaataaagttaacaagcttcatttaattgacaaatagaaatttgtcccctatgaataaagcatacattgtttccaagtgcatttgagcacaaataatagaatagaatggaatttaaaagtggttgaaaccatcagggcatattctctgaactcaaggcaataaagctacaagacaaagatatagtcctttgcaaaaatccatcttctcaaaaattttttaatttccgtttttagtttggatatcgggggtacatgtgcaggtttgttacgagggtgtgttgtctgatgctgaggtttgggcttctattggtcctgtcatggagatagtgcacatagtgtccaataggaagcttttcggcccttgcacccctcccttcctccctccgtttggagtccgtagtatctcttgtccccatgtctatgtccatgtgcacccaaaatttagccaccacttataagtgagaatacataatattggttttctgtttctgcattaattcagttagaataatgacctccaacggcatttgtgtttctgtaaggacatgattttgttctattccatgatgtatatgtaccatattttctttatcctgtccaccactgatgggcacctaggttgattccatgtctttattattgtgaagtgttgcagtgaacatacaagtgcacccctctttttggtagaatgatgtattttcctttgggtatatacccataagtgagattgccaggtcagatggtagttctatttttagttctttgagaaatcatcaaactgctttctacactggctgaactaatttagattgcaaccaacagtgtataagcattcccttttctctgcagccttaccaacatctgctattttttgactttttaataaaagtaattctgattagtgtgagagagtatctcattgtggttttcatttgcattgtggttttcattgagcatttttaattatgtttattgaatgcttatatgtcttattttgagaagtatctgttcataggccaggcatggtggtgcatgcctgtaatcccagcactttcgaaggccaaggtagtcaggtgacttgagcccaggagtttgagaccagcatggacaacatggtaaaaccccatctctaaaaaaaaaaaaaaaaaaaaaaaaaaaaaacctagctaggcgtggtggcatacgcctgtagtcccagctactcgggaacctgaggtgggaggatcacttgagcccaggaggtcgaggctgcagtgagctatgattatgccattgaactccagcctgggtgacagagtgagactctgtctcaaaaaataataatgtctgttcatgtcctttgtccactttctaatgaggtttttttttcttgttgatttgcttaatttccttatagattctgtatattagtccttaatttagatgcataatttctgaatattttctctcattctgtatgttatttactgatagtttcttttgctgtacagaagctgtttattttaatttggttctacttgtcaatttttgcttttcttgcaattgcttttgaggacttagtcatacattatttgcttaggctgatatccacaatggtatttcctaagttttcttctaagatttttatagtttgaggccttacattaaatctttaatatattttgagttaatttttgtatattatgatagataggggtccactttttttcttctgcatatggttgtcaagttattctgacagcatttattcaataaggaatctttttgccattgcttatttttgtcagtattgtagatcagttggttgtagctgtgtggctttatttactggttctctaatctgttgcaatggtctgtatgtctattgttctaccagtaccatattcttttggttactgtagctttgtagtatagtttaaagtaaagtgatgcctctggctttgctctttgcttaggattgcttttgctattcaggctgttttttttattttttgtttcatatgaattttagaatagctttttctaattctgtgaaaaatgacattgctagtttgataagaagagcactgaatctatagattgctttgggccatatggacattttaacaatagtgattcctccaatccatgagcatggaatattttttcatttgtactgcctatgatttctttcagtagttttttgtagttcttcttgcagagatttttcatttccttcattagatgtatccctaggtattttttgtgtgtgtgtgtattacaaatgggattacattattgattccatgctcagcttgaacattattgttgtacagaaatgctactaacttaaatatgttgattttttatcctgaaactttactgaagttgtttatcaggtctaggagactttggtggagacttaagggttttctaggtatagaatcatactgtcagcaaagagagataatttgacttcctcttttcctatttagatgtcttttatttatttctcttgtctgatcactctggctagaacttccagtattatgctgaatagaagtggtgagagtaggcatccttatcttgttccagttcttaaggggaatgctaccagcttttgttcattcagtattatgttggctgtggatttgtcatagatggctctttctattttgaggtatgttccttcaatgcctagtttgttgaggtttttttttttttttatcatgaagtaatgttgaattttatctaaagctttctctgtgtatattgagatgatctttttttttaataattctgcttatatggccaatcacatttattcatttgcatatgttgagccaaccttattctgtgtaataaagcctacttgatcatagtgaattaacattttgatgtgctgctgaattaagtttgctggtattttgttgaggatttttgttctatgttcattagggatattgacctgtaattttcttttttgttgttttgtctttgccagattttggtgtcaggatgatactggttttctagaatgagcctccttctcaatttttggaatagtttctgaaggactgcctccagctcttctttctatgcctgatataattcagctgtgaatccatcttgtccagagctttttctcactgataggtttttttttattactgattcaatttctgagctcattactgatctgttcaggttttcaatttcttcctgattcagtcttgggaggttgtgtgtttccaggaatttatccatttcctctagattatctagtttgtgtgcatagagttgttcataataatctctgatgatcttttgtattcctgtgggattggttgtaatgtcaccattgtcatttctttttctttttttttttttaatatactttaagttttagggtacatgtgcacaacgtgcaggcttgttacatatgtatagatgtgccatgtttgtgtgctgcacccattaactcatcatttaacattaggtatatctcctaatgctatccctccccccttcccccaccccacaacaggccccagtgtgtgatgttccccttcctgtgtccatgtgttctcattgttcaattcccacctatgagtgagaacatgtggtatttggttttttgtccttgtgatagtttgctgagaatgatggtttccagcttcatccatgtccctacaaaggacatgaactcatcattttttataggtgcatagtattccatggtgtatatgtgccacattttcttaatctagtctatcattgttggacatttgggttggttccaagtctttgctattgtgaatagtgccgtgataaacatacgtgtgcatgtgtctttatagcagcatgttttgtaatcctttgggtatatacccagtaatgggatggctgggtcaaatggtatttctagttctagatccctgaggaatagccacactgacttgattgtgcttgtttagatccctctttttctttgttaatctagctagtagtcgattaatcttgtttatcctttcagagaacaaacttttcatttcattgatcatctgtatgttttttggcagtctcaagttttttttagttctgctatgattttagccatttcttttcctctgccagctctgggattagtttgttcttgtttttctaattcctttaggtacaagtcagattattaatttgagatttttctatcttcttgatgtaggtgtatatccctgtaaactttactcttaacactgcttttgctctcagagatttgggtatgttgtttctccgttttcatttgtttcaaagaattttcaaatttctgccctaatttcaatgtttacccaaaagacattcaggagcaagttgtttaatttacatgtaaaatatgtggttttgagagttcttctgggcatttctattttttttttaatttttatttccataggttttgggggaacaggtggtatttggttacatcagtaggttctttagtggtgatttgtgagattttggtgtacccatcacccgagcggtatatactgaacccaatttgcagtctcttatccctcacccacctcccactattttccccattttattccactgtggtctgaaaaaatgcttagtatgattcagttttttgggatttattgagacttgccttatggccaaacatgtggtcaatttcagattatgttctgtgtgcagatgagaagaatgtacattctatgattgttgaggggagtattcttaaaatgtctgttaggtccaatctgtcaagtgtctaatttaaatctataatttgtttgttagttttctacaaagagagaatctgtctaatgcttcttggtgggatgttgaagtttcccactattattgtgtgactgtctaagtcttttcctgggtctataagtacttgtttatgaatcccaatgtgggatacatttagattcaggatagttaagtcttcttgttgaattgaaccctttatcattatgtaatgactttctttgtccgtttttattattgttggtttaatgtatgttttacctgatggaagaatagctacccctgttcttttttgcttcctgtttgcgtaatagatttttctccatccatttactttgagcctataagtgtcattgcatgtaagatgggtctcttgaagacagcaaaaagtggcttttgttttttttattcatcctgtcactctatgtcatttaagtgtttagaccatttacattcatggttaatattgatatgtgaggttttgtttctgttatgatgttgttagcaggtttctttgtagtctgattgcatagttgctttatagagtctttggcttatgtacttatatgtgtttttgtggtaacagattttgttctttcatttctatgtttggaactttcttaagcatctcttataaggctagtctagtggtaacaaattcccttagtgattgcttgtcctcagaactattttagtccctttattagtatttagtttacatataataaaattaaccaattttaagcatataagttttgtcccatacttataatcatgtaaacattgtcatgatcacaacatagactatttctatcttcaaagattatgccctctgcaatcaatcttttcctcctactcctggtctcctgcatccgccaatcactttatctcgctgtatttttgcttttcctagaatttgatgtaagtatcatatagtgatacgagtgatgtatgatgtgtatgatgtgagtatcatatagtacattgtcttttgtgtctggcttctttcattcaacatagtgcttttgagatttatacatgttgtttcttgtatcagtagcttgttccatttggttgctggttaatatgccattgtatgaatataccacactttgtttattcattccccagttgatagacatctaggcttcttttcagtttgggtcagaacaatgacgtacaagtctttgcatgactccatgatgttatttcacttgggtaaataactaagtgtgggattactgggtcatttgacaagagaatgtgtaattgtaagggaaactgccacatttgcctttcaaacagcagcttatgagatggtcagttcctccacatcctacacaacaattcatattgtcactctttcattttagttagactaaataattagactagtggttgtgtagcaatatctcactatggttccatttaattttgataaagtaagtagatttagatcttttgcccatatttttgtcagattgtctgaaatatatgacttctatatatttatacatacagtcttttattggctttatattttacaaatatcattcagcatgtggcctgcccttccccttttccacaatatgttttgaagagcaaaagttttttactttaatgaagtacagtttatccatttttttgtatttggctttgggctttttgtgtccatctaaggatttgttgtctaatccaaatcgtggacattttctcctatgttttcttgtagaagattcatagttttactttttacatttagatctattgtccatttccattaaaatccttcatacaaagtgaacaaaacatcatggttctttttttgtttctttgtttgcaaatagatatccaattattcagcaccatttgttaaaaagagtatcctttattaaattatgcagcacccttctagaaaaatcatgaacatttaatgagggtctgttgaccatataaatgagggtttaggtatagcctcttcattttgttccattgagtgctatgtctgtccttttgccagtacctcactattttgattaatgtagttttattctaaatctcataatccagtagtgttaagtcttcccattttttgctttttcaaaataagtttgaatgttctaggttctttgcattttcatattaattttagaatcagtatttcaacatctatgaaatatatattgggattttgattggaatggcactaaatttatagatcaatgggaatgaattgatatcttagctatgttgagtatcccaatccatgagcatggaaactcttcatatatttatatcttatctaatttctctcatcaatgttggtagttttcagcatataggtcttgcacataatttgttaaatgcacccctaactatacatgtaaatgcattgttaaattttactcctcaattatttcattgctaatatataaaaatcatattgcttttgtactggctttgttgactttgctaaacttatttgttttagtagcattatttatatttctaaggattttctgcataagtaagcattgcattggaagttaagatgattttgcttctttttaatgtatatgtcttttatttctatcttatttcattgactgaaacttccagtacaatattgaacagaagagatgagagcagacatcctcccaatgctcctctagggagaaattttcagtctttcttcatgagtataatgttagccgtagctttttacagatccccatcctaagagaaggaagtctccttctattccaagtttgctggagcttctatcctgaataaatattgacttttatcaaatgatcattttgcctctattcatgttttttttagtctatgatttggtgatttaccttgattatgatgttcaaatgttaagccaaccttacattcccagaataaatcttactttttcagaatacatgtcctttttaacatttatatgagtttagtttgctaaaatgttactaaggttaattatatctgtgtccatgaggatactgatctacagttttcttttctttttttttttttttgagacagagtctcaccctgtcgcccaggctggagtgcagtggcatgatctcggctcactgcaaactccacctcccaggttcacgccattctcctgcctcagcctccccagtagctgggactacaggcacctgccaccacgcccagctaatttttttgtatttttagtagagatggggtttcaccatgttagccaggacagtctcgattacagttttcttatagtgttttgtctagttttagcatcagtatattactattctcgtgtacgggttaagcatccctattccaaaactatgaaatctgcaaggcttcaaaattgaaaacatgttgagtgccaacaaatggaaaattccacacctgacctcatgtgacagcttgtagtcaaaacatacagcacacaattttcagccttcccaaggataaaaggaccccccagccctgtttagctgtgatgtgtcttctccatggacactcatgcaattatttccacaaaggacaatacagtatcatgtgtgcaggctagacacaccaaacagcaggttctcccatgatgctccatatagggccaagacatatgttttactcattgtggttttttgcttattctctgcaatgtggtataaaaatattatggaaaatgtcaaaaaggcctgcagacacccctatggtaacagtgataagaataagaggaagcatttatgtttgtctgttgcacagaaattcaagttatttggagaaactggatgatcatataagtatgaaatgccttacagaagagtatggtgttggaatgaacaccatatatgacctgaagaaacagaaggataaactgctgaagttctgtgctgaaaatgatgagcagaagttaatttaaaaaattgaaaaacactgaaccaaactaaaaatggagatctcaatcatgtattgaaagagtgcatccatcagcattaccgtgaacacatgccacttaatggtatgctgattattaaacaagcaaagatctatcatgattcaatgaaaattgaggggaattatgaatatttattaggctacttgcagaaacttaagaaaatacacagcactgaattttaaaagatttttggtaataaagcatatgctgaccatgaggcagcagagaaatttattgacaagtttgccaaagtttccactgatgaaaatctgacactggaagtccataaagttgttgacacatcactgttttggtgttattgccccagcaagacactgactacagctgatgagacatcctctataggaacaaaggatgccaagtgcagaattgttgcattgggatgtgctaatgcataagacacacataaatgtaaacttgccgtcacaggcaaaagcttgcatcctcactgttttcaaggagtgattttcttaccagtccattattatgctaacaaaaaatgcatggatcatcagggacatcttttttctgattgatttcacaaacattttataccagtagcttttgcccacggcagggaagctggactggatgatgactgcaagattttgttatttcttgacagctgttctgctcatcctccagctgaaattttcatcaaaaataatgtttatgccacgtacttaccccaaatgtgacttactgagttcagccatgtggtcagggtatgcttagatcagtgaagagtaaatataaaaacactttcttgcacagcatgctagcagcagtgagcagaggcatggatgtggagtgttttcaaaagaagtttagcatgaatgatgccatatatgctgttgccagtgcttggaacacagcaactaaatacacagttatacaggcctgacacaacttctgtcctgtaactatgtccactcatcatgatgaaaaaagtgatcactttgaagtattccatatgtcaagtgagggaagaaaatgcctgaccttacatatgcaaaaaatataccttcagagtctgtcagtcagctggaagaagtagatattaagaagtttctaaaatcagtaattaaactccagttgttccttcattaaccaaacaatggtgaaatagtcaaacagttctgaaacaaggtgattgtaataataatgacattgaagataatattggtaatacttcagaaaaagtgcccatagatgacatcatgaaaatgtgtgataggtttattgaagcactcactagagcagcatgcatttataagacaactagaaattatgtcagtttataaaatcaaagagagacttctaagacaaaaatcagtgtcaaagcagataactctggagaagatatttttaaaagccattctagcagaatgcctcctcatcccgagagaagccacctcctagtccctcaactgcttctgatgttccttctcacctaaataaaaaacagtgtacagtaaccttttaatcaaaacatgtgtataatatgtaatatatataataatgtaggtggagactgaaagcctgctgctatctgttgtttaacagctgatacaggtattctggtgatgctagtgtgctatttggttaccctgaatacattattttttcactgtattaatggcatgtcattattttactattatttatttgtgaataaatatgagaaagtgattatcagtaacgtaaatttatagtcaagaatgatggtgatgccaaaccaccacagattttccacaggaatatctgaggtaatgacatctttgctttctcatggttcaatgtacacaaactgttttacacacaaaattactaaacaacttttttttgtaaaattaccttcagtctatgcgtgtaagatatatctgaaatataaatgaatttcaggcttaggcattatcctgtccccaagacatttcattatattttgtatatatataatacatatatatcatatataatgcaaatatatatatgcaaatatttcaaaatccaaaaatacctgaaatctgaagcacttctggttccaagcattttggataaggaatattcaacctgtaattagttgggaagtgttctcacctcttttgttttctggaaaagctgtgtagaactgatattttttccttaacgatctggagtattctttgttggaaggtttttagcaatgactttaatttctttagtagatataagactactcaagctatctattttttctttagtgtggtgtgattgtttttatcttttaagtaatttttttattttatataaggtgtcaaatttcttgtcataaaattattcataaaatttccttattattttaatgtctatggtatctatacagatttacagacttccatttttatgttgataattaatattttctcattttcttttctgatccagtgtcactaggatgttgtttttattgatttttctctagttcttttatgttttattggttttgccctttatttattatttctttccttatatctcctttttgtttcattttctcttgtttttcatgttccttaagttgaaacttaaatcattattttgaaatgatacttttttttgaacataagcatttaccgctatagatttcctcataagcactactttgtttgtgtcctacagattttgatatttgtgtttttatttccagttcattctaaaataattttaatatccctgttatttttctttaatttgtggataatttggaaagatattatttaatttctaaatatctggagattttccagatgtctatgagtaaattttaatttcatttcattcttgacaaaaaatatacttcattataatgttagtcttcttgagtttaagggccaagaatatggtttatcttggtggatgttcagtatacacttgaaaagaatgtgcattttgctgttgtaggatggagtattgatgggtggagtgaatatcagttaggtcatgttgattgataacattgttcacgtcttttatattcttacttcttctcttttcgtatgttcagtcaattactactaatagagcagtgtttaaatctctaactctacttgtggatttgactgtttctactcttgattatatcagatttgtttagtgtattttgaaagtctgttattagatgcatacacatttataattgttatgtctgtttgatgatttgaggaccctttatcaatgaaatgtctgtttcctccatggaaatgttccttagtctggaatcttctttgagattaatacagtcacttcagctttcttttgactagtatttacatggcctaatttgttttttatcctttaaaaatctttttttgtgttgatattttaagtaggttttttgtagacagcatatagttgagtcatgctttgttatccaatctgaccatttctcttctttcaactgaagttattaagtatacacattgaatgtaattgtcaatgtttaaatctgccttttctaattctaattgtttcatccatacttttgttcttatttttctcttggattgagcacttttattattccattttatctgtaataatggcagactatatatactgattagctttttagtggctattttagtatttgaaattatacctctttatcttatctaatcttaattatttcctttcttctgcttactttaatttgttcttatttttctggatttttagaacagaagctgaggttattgacatgaaatttttgtccttgtcaaatagatatttagtgctgtaaatttccctgtaaatactgctttggctgcattccacaaattttaatatgtgtgttttcattttaattcaggtcaaaatactttctagttttcctttggatttcttctttgacctatggattatttagaaatgtgttgaggccaggcacagtggctcatgcctgtaatcccagcactttgggaggctgaggtattgagctcaggagttcaagaccagcctggccaatatagcaagactccatctctacaaaaaaatttaaaaatatatccaggcatggtgacatgtgcctgtagtcacagctactcgtaaggttaaggtgggaggatctcttgagcctaggagattgaggctgcagtgagctgtgattgtgctactgcactccagtctgggcaacaaagcaagaccttgtctcaaaataaataaacagagagagagagagagacacacacatgtattagtttccaaatacactgatattttttagattccttttcattatttatttctaatttatttccattgtggtaagaaaatatactttgtatgattgaaattctcaaatttaaatgaaacctgttttataattcaaatataatctgtcctgtatagtgttcttggtgcacctaaaaaaaaaagaatgtatattctattactgtttggtaaacggctctttataaaatgccattagttaggccaagtgagctgatagtgttatttaggtattcaaatctctgactataattagggatgtgtctgtatatttatcctcacagttcttttagtttttgcttcatgtattttgagagtgtgctgtgaggtgtgtaaacatttagaatttttatacatttttaatgagttgaggcctttatcataatgtaatagctctatttgtccctggtaatatttattgctttgacatataatttgtctgatattaatttagccactccagatatatttttattagtattagtatggcatttatttttattagtgttaattatttttattagttaattcttttactttttatctatttgtatctgtacatttaaggtagatttcttgaaggcagcatataattgagtcttgccatttattgaatcaggcaattgttgcctttatttagaggttcagaccattcacatttaagtaattattgggatagtttagtttaaatttactaccttactatctgatttctatttctatcaaaatttgtctcttctaatctttttctcttttccttttcgctgccttttttggattaactgaatatttttaatcattgatttcgtctccttttttggtttattagctataactccttgttttattttagccaattctttcaggtttagagtatatatctttaacttatactggctaacttgaagtgatattatgccatttatactatatatagtataagaaacttacaacagtttcaacaattctagctggggttatttgggttaataaaataaacatttatgcatctcaatatcgatttttcaaccccagagaggactctaagtggtcctgtttggattatgtgcatatccctaaacaaacaacagtggacaagggcatgaatgctttggtcaacctgaattcccgcagaaatttctgaaggaaattcataaaggtgggaaggagttcaccaaacaacctaagaaaaggaatgcaaaagtgcacggattagacaaaaactacagtgatcaaaggccactacaaccatacagatcacagaaagagtttatagatcgacagatagagaattcacatcagcttgctataaattcccaatatatctttctaacaataccatatttagccacacaaagcaggggtaaatgaagctttctttgtatggtgtttttcttccccttgtgctttccagggtacccagctgtcagtaacacttcttcacatctgatacctgtcaaggttaaaaaaaaaaaaaaaaaagccaaatactctgccaccctttatatttgacttttattatcattccagaaaacttttagtaagaatctaagcatttctgtgtaaatcagagttcctcaaccttagcactattgaccttttggactagataattttttgtattgagtggcttccctctgcatcatccctgagctctacccactagatatcagtaacacaccctcctccacagttgtgacgagcaaaaattcctccagatagtgtcaaatgtctcgttggggagcaaaattactcccggttgagaaccactgattgaagggaatgtttacaaacatcaagagctacagcttcttgacaacaaatcagcatcagctcatggggagaaagcagaattagcatcagatgccaatgaactcttgttccatatcccagcaagcccatatctcctcaaaacatagtgtctgttgtttaccactgatgatttagctcccagcatctggaaaaaacaatgctcaaataccacaaccacaacaaatgctaaaagaataggtgaatggatgaataaattaatggatggatgaatgagtgaaaatttaaaaatctggatgattattcacactgttgctcttgggaaatgaatgacataggctagtatatgtatgagaaaatgggatattttactattttacttgaaaatttctatattggaattttgtcattttaattttataatttagaaaactttaaaggatttattttacaagcacttgaaaataaaatcaagcattttctccttgagaacttttttaaaaatttgcttgttttcattagaagagtcaactaatatttattgagcatcttttattgttgaactaggggctgttctaggcagctgggatgcaacaagacagagaaagtttctgttcttatagagcttacattcctttttttgatacaaaatattatagatatatatggggtacatatgaatatttattacatgcatagaatgtgtcttcgtcaagtcagagtttttggaggatccattatcttgagtatttatcattcctatgtgttggtaacatttcaagtcctctcttctagctactttgtaatataaaatatattgttgctactatagtcactctactctgctatcaaatattggagcctattcttctatcaaactgtatgtttatatctactaaccaacttccctatatcccacctgccacccacacacccttcctaccctctggtatctactattctagtctctatctccatgagattaacttgtttagctcccacatatgagtgagaacatgtatctgtctttctgtgcctgacttatttcacttaacgtaatgacctccatttccattcctgttgctgcaaatgacatgatttcattcttttttatggctgaataatgttcaattgcgcatatatatatatatatatatatatatatatatagcacattttctttattaatttgtccgtcgatggacacttagattgattccatgtctttgctgttaagaatgcccctgaagtaaacatgcaagtgcaggtatccctctgatacacggatttcctttcctttggttaaatacctggtagtggcattgctggatcatatggtagttctatttttagtttttggagaagactccatgttgttttccatagtggttgtactaatttacattcacaccaacagtatataagaattcccttttctccacattgttgctagcatgttattttttgtctttttaataatagccattctaactgggataagatgatatctcaatgtggttttattttgcatttccctaattactagtgatgctgagcattttttcataaacttcttggccatttgtatgtatgtcttttcttgataaatatctattcatgtcttttgcccacttttaatgatattatttgggtttttaaaaattttttagttgtttgagttccttttatatcctgcatactagtccctcataggatgagtagtttgcaagtattttctcattcaacacattttctcctcactctgttgattgtttcctttgctgtgcatgagcttttaaatttaataaatttaatataatcccatttgtttattttttgttttattgtctgctcttcaggcaggccttagccatgaaatatttgcccagaatgatgtcttgaaatgttttctccatttttttagtagttttacagtctcaggtcttatgtttaagtctataatttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttaagtctataatttatcttctgtttatttttgtacatgagaagccataggtatccagtttcctttttctgtatgtggatctccaattttcccagcaccatttattgaagaatgtattctttctccttggtgccttcatcaaaaatcagttggctgtaaatacatggattcatttctgtactatctatcctgttccatttgcctataaggctgtttttataccaatactatgttgttttggttactgtagccttttggtacattttgaagtcaggtagtgtgatgcctccagcattgtcgtttttgttcagaattgctttggctattcaggctctcttttggtattatacacattgtaggattgttttattaattctgtgaaaaattacattggttttttgatagagattgcattaagtctatagttgctttaggtagtatgattttgtttttttgtttgtttgtttgagatggagtctcgctctgttgcccaggctggagtgcaatggcatgatctctgcttaccgcaacctccacctcccgggttcaagcaattctcctgcctcagcctcctgagtagctgggattacaagcatgtgccaccatgcccggctaattttgtatttttagtagagatggggtttctctatgttggtcaggctggtttccaactcctgacctcaggtgatccactcgcctcagcctcccaaagtgctgggattacaggcgtgagccaccatgcccagccagtagtatggtcattttaacattattaattcttctgatccatgagcatgggatgtctttccatttgttttgtcctcttcaatttcttcattagtgttttgtagtttttcttatagagatctttcaacgccttagttaaatttgttcttaggtattttttgtagctattgtaaattggattaccttcttgatttctttcttggctagttcattatcagtatatagaaatgctactgatttttgtatgttgatttgcattctgaaactttactaaatttatcaaatctaagagttttttggtggagtctaggtttttccataagatcatatcatcagcaaagaaatggttgacttcctcttttccaatttggatgccttttattttattatttcattttttttaatttgttttcctcagagatccttgttctgaatgatgccttttatttctttgtcttgcatgattgctctggctaagatttccagtaccatgttgaataagagtggtgaaagtgggtatttgtgttgagttacagatctgagaagaaaggctttcatcttttcagtagtagtgttcatactaacattcagtatgatgttatctgtgggtttgtcatagatgacctttattattttgagacatgttccttctgcacttggtttattgagagtttttatcatgaagggatggtgtattttatcaaatgctttttctgcatctattgagatgatcatatgatttttgtccttgattttgtttatgtgatgtatcacatttattgatttgcatatgttgagccatcagtgcatccctggtataaatcccatttggtcatggtatattatctttttgatgtgtgttggatttgacttgctagtagtttgttgaggatttatgtagttttcttttttgttgtgtccttgtcaggttttgtcactgggataatgttggtctcatataatgacttgaggagaggtctttccactttcgttttctgaaatggttttaggaggatttgtattagttcttctttatatgtttggtaaatttcagctgttcatccatccagtagttgggttttctttcttgggagactttgtattactgattcaatcttgctactcgttattggtctgtttaggttttctattttttccttattcaatcttggtagcttgtatatttccagaaatttatccattctcctaggttttctggtttgttagtgtacagttattcataatcgtgtgtgatgatcttttgtatttctgtggtatcagttgtaatatctcccttttcatttcttgttttgtattctgtgttcttggttagtctagctagtggtttatcaattttgtttatcttttttttgaagaatcaacttttcatttcatttattctgtgtattttttagtctatctcatttagttcagctctttattatttcttttcttctaattttgactttggtttattcttgcttttgtggttccttgagatgcatcattgggttgtttgtttgaaatctttctacttttttgatgtaggcatttattgcctatgtcaaacttcctcttaacactgctttcactctatcccattggttttggcacatgtcttatttacatttgtttcaagaaattttttgcttttcatcttaatttcttaattgacccagtggtcattcagaagcatgttttttaatttccatgtatctgtaggtaccagagttcctcctagtattgatttattgttttattccattgtgacctgaagatacttgatatgattttgatttttaaaactgttgagaatcgttttgtgacctaacatatgctgtatcctggagaatgtttcatctgcttagaagaatgtatattttacagttgttgaataaaatgttctgtaagtgtgtgttagttccacttggtctaaagtgtagtttaaatccaattttttgttgttgttgattttctgtctagatgatttgactaatgctgaaagtggggtgttgaatttccccaatattattttatgggagtctgtctctctctttagctctagttatatttgctttatgaatctgggcactccagggttggatgcataaatattcagaattgttgtatcatacctcttgctggattgatccctttatcattatataatgaccatctttgtctttgtcatttttactgtttttgacctaaagtctgtttgatctgatctaagtatagctacttctgctgactttgggtttctgtttgagtggaatttttttgcatccctttactttgggtgtatatgtatcttgacaggtaaagtgtatttgttgtaggcagcatatagttggataatgttttcttatatattcaaccagtctatatattttaagcagattatttaatctatttccattcaatatctcttttttttttctttttgagacagagttttgctcttgtcacccaggctggagcgcaatggcgcagtcccagctcactgcaacctctgcctcccaggttcaagtgattctcctgcctcagcctcccaagtagtttggattacaggcacctggcaccacgcctggctaatttttgtatttttaggaaagacggggtttcaccatgttggccaggctggtctcaaactcctgacctcaggtgattcacctgcctcggcatcccaaaatgctaggattgcaggtgtgagccaccatgcccggcctcaagattgcttttaatatgcaaggctttgttcctgccatgctcttaattgttttctgatcgttttgtatgttctttattcctctctttttttctaattgtcattttggtttggttgttttctgtagttgtaccatttgaattctttctcttcctcatttgtgtgtttggtgtaccagtgagttttatactttgatgtgttttcatgatggtaaatgttatcttttttattccgggtttaggacttctttggatatttcttctagggccagtctagtggtgataaattccctcagcattttcttctctgggaaggactttttttgtgaaggataattttgctacatagtatatacttaagtggctttttttcttcaccactttgaatatgtctctcttgccctgtattgtttctgctgagaaatactttcttagcctgatggggtttcctttataggtgactagacacttttgtcttgctgttgttggaatcccctctttatctttgactttaagtagtttgactataatacgctgcagagaagaccttcttgctctgtatttgtgtggggttctctgagccccctatatgagtcttttctagattggggaagttttcatctattatttcattaaatagattttctaatcctttcattctctctttgcccttggggacactgataattagaatattgagtcactatgttgtcccataggtcacaaagcctttctcattcttttttattctttttatttatttttgtctgactggattatttcaaaagatttcaagttctgagattctttcttctgcttaatctaatctattgttggaggttttgactgtattttgtattttattcaatgaattcttcagttccggaatttatgtttggttcttttaaaaaaaatgtgtatctctttgatgaattcttttccaattttctgtattgtttttcaaaattatcttgtttgctgagcttctttaaaatcagtaatttgaattatttacccatgatttcattgattttttattggtatctgttgctgtagaattattgtgttcctttgaaggtgtcatatttccttgctttttcatgtttcctgtgtccttatgttaatatctgcacatctgatgtaacaatcacttattccatgttttttaaatttgcttttgtagagaggactcttctctgaagattatctatgatgttggttgagtagggcactttggctttgattttggatgcaagcaatagcgtagtttctgtatgatctccttggctataaatagtatcagtggtatctgtgatttatttccttgatagcttagggtgtggttattagtggaggctgtggtaaagttttctgggaactaggttattaggtaggccagtggtacagcagtggtctgaagatgcctgtctttgagccccagagtgatgtatgctggctctggtattagtgggtccaagtgggccaattactgggcttccaggtggcttgctgaaatgctagtagtggcagcagtgggcctggcatgtggactggttctcttgcccttggtcagcagacttgatgtgggcaatggcaatagcagtgattgggccactcactgaaatccaagttggtctgagctgtaatgggttggatgggccagtctcatggtgcttgcaagtgagtgccaattgtggtggttatcagggggttgagttgcccgcacctcagaccctgggaagagtgcacatgtgccaacagtagtggactaggctgggtgatttccaagcccctggatggcatgctcaagtactgagaagacaggactaggttggcagaattgagacttgtcctcaggtcccctggtaatatgttcaggcatggctatgataggtaggaacaaggtggtccccaggcagtcagcagaatgctcaggtgagggcactggtggcttcagttcagggctgccactggggagggcacagacactctcattgggagcagcataggtaggtagttgtgcagcatgtgatttgctcatgcctcagtcccccagcagcttgcagctctagtgacagcgggatttatccttagggtacacaaaagtatctggcctcatctcctccctggcctggtggtagcatcagtggcatcaaaaccagggcaagacatagtcctttaggggctcggctttcagaatgtcactgtgctgctcagggcttacaggcctgtgggtcacagcatgagctccctctttgaagcaataccactgtgcaatttctaggcagctctctgtgttagtctctaggcctgtgaggatcgaggggctctcctgtcagtaagatagtatgtggtgggaatgtggaccctgggaggtctctcacttaccctttccctgtgttagggagcttctcccagctcccagccaaaccccccgagcaggctacattgcttccatttcctctgttacctttggtgcttcctgtcacttttttgtggaattccagtgttctctcttagatgatctattccaagtgtgaatatctacttgctattttggttcttttccatggtagaggcacatagctgcctgttgtttgtttgttccttttttttttttctttttaagagacagcatcttgctagattgcctaagctgtacttgtactcctgggcccaagtgatcctcctgccttagcctccagagtagctaggattgtaggcacgagccactgcacccagctaatttgctattttgtaaagtacaaatatggacttttgcctggtttacattctgaatataccatcaagtctgaggtttgatttttttctcttttaacttatgagcaaatagccatattgtataaatatttttgaatgggcttatgtcggaggaaaacaaacaaaccaccatacctagcatggaagtaatctgacacatcacatttaattatgtgcctcagccttgagggcagagattagacggcatgcattttcacatcccgaaccttacaaagtgtgtgcacagtgcgggccctcaggaaatgtatgttgaaagaattgattaggaagtttcataggcatagttttggttaattctgtatttactttgccaaaccaagattttctgagaaggatgaggggagaggagagagctaggtgccgtgaaaagccttttaaaggaagaacagaagttgaagagcaaagtgggccagggagtcaggaaacaaaagggtgatgtgtggggacagctgtggtctctctttcctttctgccaccagcaggaggctgggtcaatccttccctcttcagtaagggcagacactgctcctgcaatggggaacccagcactgcagaacaagccagagtctgctgtgtgtaaaacctccagtcgtatagaattctagtccccaagcccccatatctcccaaaaggggaatgcccagtcacatgggtcccttgaggtcatggctccaggaaccagcaaagcctagcttgcaaggagaggtcatttatttacactgggcaagcaatgcatgatgcaagaagacacagagtctgccttagtgaccaaagagatccctttgcctcattctcctgtggaagcaatcaagaaagggaggttgggcgaggtgaccttccagagccgaatctgtgcttctaaaaatagaagcatccttggagaactgagaaggggagggaaagctttggacattgagggcaagaacctgaatccccagagcattgtcagtaggaaactgtattaattagacacaggcacctcagctcgataacctcaggtatctctcagaaattgaaacgaaatgaaatggctttttttccctcctttctggttatactgtccctgagctaaaaaggagaaagagaattgtgtcttctgacctatctgaatggctgcacagtgcctgagatatcttccccagtggagggaaatggggagtctttagaggcacgccagcaaaagaaaagagctgctgcaaagtggaactgtgaaaggcaggcagcagggccacctgggggtctgggtctctgttctctccctgcaaggaggctgtgcgggactaggcgagtacttggctgtgtccagggctctgaatgtgtgggctcgcagggtgccactctcaggctcatgcagtgtccttgtttggagctatgcgatagactgtaagtttccagggtccagtggagccgtgtgctggtctgcacagatcgtatgcagccagggtgtgtgctgagctctgtggcatggggatcgcgtgtgggagattggaggtatgcaggagtacacagggaggatatggtcgcaagtttgagggggctgtgtacgggagtgtgtggggtggtgtggaaacctgttgagaggcttcatgatgctgcatagggctgtgtgcagagctaccctgggccgtgggtggggcactacagtactggagggcacctgtttgtgtaactttgacttagaggctctgtgtgcattgtagtagtgatatgagtggagccacataggggagtctgtggaggatttgttaaggctgtgagacttatgcactggaggatgtgttctgggctacctggacacatgagtctgtacagggctgccggtgactggatacatggtggcagaggcctgaacagggttacagctttgccatccaaagataggctgtgcctcctcagggtgaggtgctcccaaagtgcagggatttattattctccctgtgactgacatgaacggaagagataccagggattctacaagctgagcaaaaggggcagtgtgttccctttcagtgtggcctgaagctgagcctcttgcacaccaggctggagacactttctaatactttagtttgtgctttctcaacaggacaacgtggatctgggagagctgatgttttccctgtgctatcttccaacggctggcaggctgaccattaccattataaaagcaaggaatttaaaggcaatggacataacaggagcatcaggtggggcattttcaaattcagacttcctcatgcacttctactgtagtaagtaccttataaagttttagtatggtaataaagcacattgactctggaaccagactgcctaggcttagccctagtcctaacacctgtgtgaccttgggcaagtcattttacctctctgagctttggattcccatcggtaagatgagagtaattatagcgtctggctcaccgggctgttgtaaaactgaattcataaatataaagccatgagaacagtgctagcatatattaagtgctacatattgttaattattgttattattacatttagccttctatatccaccagttccacatctgtagattcaaccaacgatggattaaaaatactcaggaaaaaagtaatacaacaataaaaataatacagttttttaaacaatacagtataacaactatttacacagcatttatgcctgattaggtattgtaagcaatctagagatgatttaaagtatacgggagaatgtgcgtaggttatatgcaaatacgatgccattttatataagggacctgagcatccttggattttcctatctgtgaagggtcctgaaaccaattccttgtggataacaagggacaatagtactctcttgggtctccctcaccataattgtgaattggacctaccatttacacacactgataaagcttatctaattgggtctttcctcaaatatcatcatcccaggctcattgaagactgagaacaatcctatgtccttattaaagggaactatgaattttagatttttccagtaaaccaagcattaaattctgaactctaacaagaaaaaaaaaatgcctctatatgcattgctaactgtgcaaattcacaagcaacctctgcaggtgtttcccaaatgtggtcacaaaacacccagtacaccctggcttacatcctctgaaatcaaagaacatcagatgcaatatattctgcatcctatatcccagtgtttttgtttttttaagcagaaagaaaaaaaagctgtggtccctctggtcatctaagtccctactggactgcatataggagtcagagcaatgcatggttatgcaggtgaaaatagaacaaggacttcccaataaacagaagaagagtgagatagctgttaggaccagaagagccctatctggagcagaggccagccttgccacctgttaccccatcacagtgttgcaccccaaggaagcctgtggcctttctctccctgatatgctgagctgcttctccttttgcaacccaagggcaggccactctaggggctcaaggtctctatacttaaggaattccactcccagatgttctctgtcctctaggaattcagaaattcagagtctaggaattccctttcttaaagacctgaaaagattccctgaggtggctcagagctggggggcctgttttcagccttggaaatgctggtgcatttctcttgctatcctggccaggccagtcttgagttctagctggaatgtctcctaattccttaacagatgttttcaaactatttttaaattacacacattttcaggagacagtatcctgtgctttttcttgaatgagtgacttaattatcctaactagttgctccccagatatcatattaatgacagtcctccaactccagtccacaggcaggtaaaggagttcagcataccatagtccatgaaaactcacagtgatataactgcccacctaaatctatacgtatcctcacagtactcctgcttctcatggtctgtccagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccggtgagatacctggaactcttttccagtgcaagttcactgtgcccaggactgggaaggcagagggggagcagcagccacagattcttacctggtgtcccaggctgcaggaaatgagtcaactagcagtgcatgggaagcacattgacaggagtcacctctaaaccatgctgtagagtcagactaccaaagtgtctctcagcactcccattcttttctgccccgttctcattttttttcctattcctacatcctcccccaacctccacctcttccccttttcatctttgcacaactcctagaatctcagcttggagagctgtggccccacaggttttatcttctgtcaggcagtgctaactgcccttcattggaaggattccactcaaaatggcagaatgattactttcgccagaccatcaacatttccaaatacataacttcaatctttttccttctcacaagtatttaataaagattgtttccttctacttaagtctgaaaacaaacacagaaatgttctcctgaaagtgctagaatcagtatggatgacaaggtacattaaaatgtataagatgctcaactttttaattaatacagcacagaagagatatttatagcctgcattgtagccaattgtgtatttaaaggacagatttgaaaaacagtcattttaatatgcaaaggaagtaccaacagggaattatacatgttaaaccagtcattagactaaaatgcaaagtctctctttaattggaaacctcccacgtggtctggacacaattattaaaaaaaatattctgacttctaatattatttgtgactaagaattttcccacatacctctgaaatatcaggaaggcagcttcagtgacctgaacactctttccagcagatgcctgcgtgaagcatgacagtcttccaacccaaggagcacgtgggttggctcagctgcccatgagtgtgacagcccatgctgagcagtagaccttgtcccatctcctgtgggcaagaaacaacaccaacagtgtcaggccccagtaggggacattgcccaccaactgtggaagcctaggccagcaatttttaagctattgccaagtttcctgcatggacaaatctgattatgtgagctctgccttaatttaattctcagtaaactcatgaatctggcctggaaaaattcatggcagaattcatggggcttctgcatgcatttgattttaatgggcagagactcaaatatccttcacgtgacctccccaccctcatctcacctttatgctccatacacaaataggagaaaaatcactcatctttgcaggagggaaaaaaaaaagagaaagtatgtgagtttggatcccatagaattaaagaattggccatatcagtccagttataccagggactttttaaaaaactgctagagaaaacaaaaatgtctcaaggcggggacctacctagggagagtttcagaaatattagccttggccgggcatggtatctcacacctgtaatcccagcactttgggaggctgaggcaggtggatcacttgaggttaggagttcgagaccagcctggccaacgtggtgaaaccccgcctcaactaaaaatacaaaaattggccaggcatggtggcatgcacctgtaatcccagctacttggaagctgagacaggaaaattgcttgaacccgggagctggaggttgcagtgagccgagatcatgccactgcactccagcgtgggtgacagagtgagactccatttcaaaaaaaaagaaatattagcctcaaggtcaaaggagctatgtatctttctatagttgggaaactaactgggccaaagaagctgaacttagaagaaaggagggacaagtataagacaataacagtattctctaaagagaggaagcaggaagatccataagcctccttcacttaccttagtttgtgggctgaagacccatggctgccagacacaaaactgctccctcacccatgcttggttgcctcttgtgggaattagagcagccattattgcaagaaactcatttcagatgactccctctttattacatggaggccagcctagatccaggacgagaggtggcatccttagcacaaatcgtggggttctttgaacaaggttcttggaaacaagttgacccatgtcagttttaggacagccagggtatacgttagatcccaagtcctattggccgtgaagcttagcctgtagttttaagtgaggaaatgaaaaaacaaacaaacaaacaaacaaaaaaccacatccccaattccttcatcagtttaattgagtagctattgatcttacataccaaaattttaagaaaaaactattgtgggccattttcacagtgtaggtcacaatgagatcatcggcgtgtgtcaagtaggcaacgaggctgagaggctgggcagagaccactggagtgaaatgttgtcatatcctcggaagcccattgcacactggcattccctggtggaggtaagaccctaatccacatgctccactttgcataagagtaaatgctttactgttgaaatgcaggagctgccaaacatatgagtgcaccaggatctatggtcatagacgggttttcctggttgcatttcctggggctgttgggacttgcattcaatttgaggctgaatctgtgcttcccaccagtctggtaggttttgagtattgatcagagatcatccctcattttgattgtatttttaaaagatcaagattctctgcttctgtgttaaggctttgggttggtacttggagggcatctgcaaggtgtgggtgagtggggactttcaggccttcgtacagtgacttgagactgactttggaaaaaacataaggccttgattctaagaccagctctggcaccaacctgtgattctgggcaagtgggttagtatcaggttcaactacatataataaaaaccaaaacaaccaattataaattaaaaacaaatgaaatgagaatttatttctctctcttatatacaaaaagtctagaggaaggcagtctggagtatcttagcagctccatgatcaacaagagacctagacttctgtctttctgcctcacagtcccagtgtggctttgttccttgaagtcccctcattatacaatatggctgctaagctccaaccattgcatattttctaggccacaaaaatgtgcaaaagggcaagagccaaaagggcacacattccctttttgattctctttgaattctcatgcaagactgctatttacatttaatttagtcacaaaacttagtcacgtggacatgtcaagttgcaggggatagttggaaatgtaacctttttgttgggtgtcaatgtgtccaactaaaaaccagggttctgtttgcagagaagaggaaagtgaaaacctggagtcaaccggccatcattctgccactcacatcctcattcattcactccctccccctttacttctcattcattcttcccctacttatctttgctcattgattcactctcttatttattcactaacttgttctctcaaaaataatttgcactccctaagtaacatgtctgagggtccaatgctataatagctacagaaaatacagatatgaataagaaacagtcctttcccttgtagaacttacagactgtaaaataaacaaaagatgacatgtaaactaatcttcgagaggcacaaatacaagcatttccatccatataaagtgctacaaaagcgcaaaggagagagatgtttactgtgcttagaggagattgtgaagcatctctccttcatgctctcaataagtaaagagaactgagcccccgggaactggaaagccaggagggcagcagcagttatttactgaggatgcgtgggttccaggcagagagctttcctctgttctcctggtgcaggaagctctcttccatgcaaagccatctgagaggccaagactagagcctcacccagtgtgggcacccctgccattgatagtcaggtgagtctggttgaagtgaacacagggcggctgtggagaggcagagaggcagagaggccccaaacccagacaggggaaccaagggacatctttgttggaagtggggcaggaaggagaaggcaggacagggtttatggattctaaccatcagggcacccagatgtattcaagaagagcctaggaccccctaatttgcgggttcttaaggatagttctgcccgtgggccataggagcaaaattgatccctaagggagacccacaggatctatgagccacttgagaaggagctggagactggtgctcactgaactatacctcacttcttcagctcctggtggaattctcaaaggagtccatctgtgggctcattagattttgggggcctgtcactagcagtggcatttagaagagttgtaatagactttttgcacccttatgagccattgctgactttaattcttattggtaattaggagtatcagagagtgttaaagctctgtgcttctcaggaaacaagaaatgagaaaggagtaaggatgaggtgtgtggtgtagggctgagaggtgagccctgattcatgcacaagcagttttttttcagtgacctgggcaggggagtagtcctgggtggagtgttgcacacgggtccctgagtggcagtatatgcacgtgttacacaaaggagagtgcagggagcaggccttggaggccttttccttcactgtggagaaaaagtgtgatataaattcattcacctgagagatattcctcaaaccccaaacactcagctttttggaaatctgtgctccacagttatgtaactgaaaagtaaatgccattagggttaaaccactgaaacttagaagtcatttgttacagcggctaaaattactttggccaatacaatggtcatttctgaactgttacagcagaactaaggaaatgaaatgcctgtggggcttatatgaagggcaagccttcatataagcagggggagggcaaaccttcctataagcagaggcagagggaggctgcctcttccccgttgcttcctgtctctttgaagtacacgtctgggactccagatccatcctgagagaggaagtgatgctttttcttttaaaaatgaacattgagctggcagaattggggcaatggtaccagatgagatgaaaaacagtattggagaggttggccatgcttcgttagcagctgtaaggatggaggaggcaacaggcagactggccagaaacattcactttggagttggaaggacctatattcgaattgctgtcctgccactcactagatgtttgtttttccccttctgaacctcagtgttctcatctgtaaagtggccataacagtgcttgtctcacaagagggatggtgaggattaaacaatctatttatatgaaatgcagcattgtagctgatatataataaacactcagtaaagttttcagttatagttgttattatgtatgccccacattctgaggggctgctgtgtgtccttatgggcctatgtcctgtgaagaaatatcatccatgtgtgtcatggagaataagagaaaggccgggaatccaccactcctgcaccccagtgagccatcatctcagagtggggggaaggggtcatccagtacttggctaaacacagatgcacatatttaagttttgtttctttcctcttttccttggccttaaagacaggctgctgttatgctctctaagaaccttttaaatgtcttctttaaaacaaaaaccagcaattaaatctcagtgctcatgataacagagtatgtgagtgtgcactcatgagcatgtgtgtatggaagacagagagagagggagagagaacgaagatgggggccctgggatttagcatggagggaggctggcctggcagaagctcttcactgctgaggaattggttaggtctaaactctgagccctgcagagatctggcagcctgctcagggttgcatccaatacaccctgaccttgccagggcaggtggcagatggaatcttcaaagccagtgagttcaaaaatccgtttctctcgcaggaattctggatgaattcactgcacactcaaaggtcagccagtagggctccctttactccccatgatgccaaaggtttggaaagctgtgaaaactcccccaagcagactgcctagggcttaggaatcggagcaccccctccatagggcctcagatgacagagctctaagagctcccttagcacggcaccctcctccaccaattcaagagaagatggtttcggcctggccatatcacaacacctttcctgcctcctgtatgtcaagatgaccaacatcataagcctcatggagaataataggaaatagttccaagttttcatcgcttccctgtgtagtgccatgtaacatctgttgtatgaataagtactaatcttggtttggtgggaagacgagacacagacactatctggttaaatgaaatttcacttttctaaaagaagaaagagaatccgatcagaatatatagtcaagatcagcactattatcctataggcataggtgtaggattccaaacaccaaagttctactcaaggcgtgccccattttggatgtctgcctcactccaagctcaacctttgtgcatacacgtacatacagctacaaaagttctgcatgtctgactgtctgctgggaccagctcattgagcctcctgcccctcttcaactcagaattacataatgccaagtataaccagaaggcagttatggtacaatatgcccagacataaacagagccctcatttatcaccctcagcctctagaagggtataaacttagagtcaaaggactacagcaactgtcagttacccagacttgtagttacacaagcagcccgtgtaaaccatctctagatattatctgtcaagtgtccagcagggcctatctggagtcttggagatccacatattcccaggagaatgtatctgattgcccaagatttgattaggtgtccatcccggtgcaatttgctgtaggtctggggtcatgaaaatgtgacctggacctacctcagcaggagttttgggagtagacttcttgagaagagtccgcacaggacagggaaattgtctaaaatgaacatgaatgactgtttcccaaaggaatttaaagtgaggagtgagaggctttagcactgtggccaaattgttattcacaacagatttaggaaaggagcaattcaccaggaaagatgggagtggggagagcatggggtgactgggaaaagccacgtaggaaatcaggttcccatcaaggggatttgggtgtgttgcagggcttgggtcttgttgagaaccagactagcagggaagaacactgagacaagacaaaaagaaaagcatggactgaaacgtacaatagggaaagtcctagaaagtgctgctactcagcaagcattaaggcccccaagactgcaggtctttggaaacacctgaattccagacccctgtcagttggtggggaaccaaggctgccaattccatgcattgccctctgaaggagtggcttatgggctagataaatgaacatagcaaaagcctaatacgtgtgttaggggatggcgaaagagaagtgagcagtcaggacgtggagggctacatgctgctgcaatatcttgcccatatgatgaggtgctcccccccaatatagtccagcatcgtgtctcatgtctcagtgtctctgagaacaaaatttttgttatgaatgaaaacagaaaaaacaagaaacatttaaatcacattaaaatagggcaagaaaacataaatttatttattatctgaaaggatacataccatcttggtaagaaacaggaagaggtaaatgaactttatcttgctaattagtagttctcggtcttttccaggttatgtcagtctctttgggataattattttctcctcttcctaggagtctcctctctccttccttcctccctcccagctaggtatagggaagtacaaaggctacctcgtggcattggctggaactgtgcatattgttctgcttgtctttgggcatcagacttcatcatcactacctctgctgctgaggatcatggctggtgtaactgtgggctatagtctcagcatagaaacttggccaccttgaggctgatgagaccccacatcagctgttgaagtccctgtggatccctgagggcaggtagcacctcccactcaatgcttggcctgggagcttttctttgcagcccttaatacagagtcattccccacttggtggaattccctgaaattctaacaaccaatactctcacatccttcaggcatttgggcacacaagggagccacaggagactcagtgccatcacaggcatcttcttcatgcctataaagttacatggtcatttctacattgttcctctagcctgtgttggcccaggggtcatgtttgccttaagcttccccctcaatccatctaaacttggggtttcaagcctgaacggtaaagccagaacctctcctcctctcttctctgtatctcttctgccaaagggtctctgcttcctctacctgtctggtggaaacaatatatatcttagcatgatttccctctacctatgactcacgctcagacctccaaggtttcctctcagcatgtaaggaaacatttggaatttggatcccctttttctcaataaggcctggctttaagataaagttgcatggtcatttctacatgtaacatgaaataagatacttatttcataggagactagctgatcatttaccttgagttatcagccctcagcttccaagaatatatggcgtttattcaatgcatgcattttctgatttacagacaataagaacattatctctgttacgtaggtattgagttagcatttggtgaacaaatgaaaaaaaaatgaatgaatgagatatatatagaatgaattgagttcccttcgttctaaagttccagaattcccatgcagtggagtacacagtagaagtcagttcagacaaggtgtaaaaaggtattgagaatggatttgtattaggctgttcaaatagagatggcccttattaagctccaagttttaattaccttttctctatttaggagaagaacatgaaaagggaccaattcctcccttggttccaataaactgccacgtaatgacaatggctttgcatttttgaataatgagaaatattcagaactgaggccccttagtgaatcatgagggtccccctctacttgatgtaggcagccaagtcctagagcgctcaatatgtcctttcataagagagaagaaacacacagagatcccaatggtgaatggcagactgctgtgccctaagtgaaaactgatcaggaggtgacaaggactttagcccacaagttgacctttctcactaggaatatattttagcagcagttttacacaaggtaatgctttgccccatctacctgtgaagataaagaagagaaaaataataggaatggggtattttttgacaaaatgaagaaattattcttcagattttgttgtaaaaaataaactattttgaatggtgagatttagcatgccagcacgcataaacacctgcagggccgctgaagcaaaactgattgcagagaacataaaaatctactacaagtttaggatctgaaaaacattaacagacctgttagaatttgtgtcaattgctgtaagtggccagaatgctgtttggacaagcaggcactgttagtattagtggggcattgtgtttccagctggtagaggttatggttaacaaacaaagctagggccattcagaccttcccaagcaaatcttctttcttgtattgaattatctgtagaaaaaaagagagagagacggtaggcattttctcatctttgtcagggatgggtgacttttgtgacttttctgaaggtttgtagagatagtaatcatacaaaacataggagtacttagggtaaacactagaggtataaaagataatgacaatgtggtagaaaataacatttctgcctgaacagaaagtcaactgcatcttgactctcctgtcattacagatgaccttgctccagtagtcactgccttggagcatccctgctgcacacttgaatagctattaaataggaaggtggatgacaatgggcttgagccatcagctgtctccatctccagggatggcattcagaggtgattgctaacatgataggccagttctttccccgcagatgaaatgaaccagagtggtttatgccactctctgaaagaaacacactccctcctgatagtgtggtgggaggaagactgttccctcctggggaatggggcctggggcaaaggcggagcaccctggcagaggacactcaggaagcccactgctcctggatatgaatctttcagaagacgcacttgtcaaatgctgtcttccaaacatcaccagaacaacctattgataagacaaagctgagtttattgctttcccaggtaatggaaggggaagggcagagtctcatttgttgagactttgaagtgtggtttaaggtgggtctctccatgtgacgagggagatgaagtggggaggtggggaccttggttaggtttggatcagtgtcatgatataatagctgaggtggaacagcaagttgaggattttgagcctgggattcaaagagtcttggggtgtaaactgttgatgctttctaaggaatagaaattgggaagtcccatgagtgaatacttaagttgtagtaatgaagacaatagaatagtacagccaaattaatggagggtctgtgttggaataggtggttttagtactcacactccagcaacaaaaagcagaagggaacctcacaaaagatcctgcccagtcctgtgggcacccatacaccgacagagtgaatatttattagttgcctctccagcatcaagccccttttctgatggccctgatttctgattaatgattctagggagcctggctccatccttgtctctggtgatggtacatatgacagttccaggctaaacctgtcaagctaaccataaggattaccactgcatacgctgattcagtccaagagtattataaaacatttggtgtgaatgtttggacaaagatgctctctctttcttgttggatataaacaaagcactatataccctgggagcagctgtggcttctttggatctctatagaagatccaggtttagggagaaaccaagcccatagatacaaagaaaccagattctcagtcatgtggttgagctcctaaatcaaacctctcccaaacatagtgttacctctggcctttataagtatgtaaacgtatatattcccttggttgtgtaagcaatattaagcagaatttattttatttgaaatgaaaaacatcttatttaggatacaggtgaacactcacactgccccagttggtgttctttgggagtgaagagaaccattcccaaagctgtcgcgagatcagctcttctgcctggctcactgcggtatgtccaatacctaacaaagtgtgtggcccacagtagactcccattaaagttttcctaatggagcaaattattaatgttcagataattaacttgtgtgttaaaacaagcatggtgaaaagagggacacttgactctcagtgacatacaaatattatataaggttaagaaaaaaactattttccttttgcatttatatgttattcaaattctacatggagtctcagggcctgtgggaagctcttcattttatgatcactcccttgagctgataaaggcacagttcctcaggagtgaagatcagtcacatagctgtcctttcccttcaatgtcttatgtgatgtactgcaattcatttatttacagcaaaaatgaagatctacactcttttaacacaataattttagcaattctagtattatttttatttctacgttatctatttttatgtaaaactcaaatgtatatttaaagtcttcagtcattggtggtagaattacatatttttttcgcaccttagataaaattcaggatgtaaaatgtgatgatattgataatcaaaatgcttgaaataaagaaaagagggtttctataaagcaaggggaactttaccattcattgagaaattatataatgcaattgtaacttttaggtatatggtacactatgatgagttatactcaaattgtcagaaacagaagcagttatgaataaggcaggaaaacaatagggtgattttttccttcatagcttaggatctgaatggtgtgtgcttagatgctttacatattaatagtaagtgttcatattagtaaagtttactaaagagcggtcataaaaccaattaatatggtttaaatatttgtccctgcccaaacctcatgttgaattgtaatccccaatgttggaggtggggcctgatgggaggtgcttgggtcatatccatcatggcttggtgcggtcctcttgatagtgagttcttgcaagatctggtcatttaaaagtgtgtggcaccttccaccctgccttgcttctgctctgccaagtgagatgctggctcctcctttgccttctgccatgagtaaaaacttcctgaggccccaccagaaaccaagcagatgtcagtaccatgcttttggtacagcctgaagaactataagccaattaaacctcctttctttataaattgcccagtcccaggtatttctttatagcaatgcaagaaaagcagtaccagaagtgaagtggggtattgcaataaagatacttgaaaatgtgggagcagctttggaattgggtaatggacaaaggttggaagagtttggagggcttacaagaagacagaaagatgagagaaagtttggaactctcttagggactggttaaatggttgtgaccaatatgctgatagtaatatggacagtgaagtccagactgatgagacctcagatggaaatgaggctcttattgggaacaagagcaaaggtcatctttgttatgctttagcaaagaactcggttgtattgtgtccataccttagggatttgtgggagtttgcacatgagagtgatgatctagagtatctggcagaagaaatttctaagcagcaaagcattccagatgtggcctggctgcttctgacagcctaagaaatgacttaaagttggaacttatatttaaacaagaagcagagtgtaaaagtttggaaaatttgcagcctaccgtgtggcagtaaaagaaaaagcttttcaagacagaaattcaagcaagctgtggaggaaccacttgctagagatattggcataactaaaagggagccaggtgctaacatccaagacaatgggaaaaagacctcaaaggcatttcggagaccttggcagcagcccctctcattacaggttcagaggcctaagagtgatgaatggttttgtgggccaggaccagggccccacggccctgtgcagcctcaggacactgctccccacatccctactgctccagctctagccatggctcaaaggggcccaggtccacctccagctgctacttaagagaatgcaagccataagcttgggcagcttccatgtggcattaagcctgcaggtgcttaactgtgggtaccagagtgaaggtttagcagcttctgcctggatttcagagggtgtatgagaaagcctgagtgcccaggaagaagcctgctgcaggggttgagccctcccagagaacctctactagggcagtgctaagggaaaatgtgggattggaggtcccacacagagtccccacaggggcagtgtctaagggaactatgagaagggggccaccagcccccagacctcagaatggtagatccactgacagcttgcaccctgtgcctggaaaagccacaggtattcaaccctagctcacgagagcatccctgggggccaaccctgcaaaaccataggggcagagctgcccaaggccttgggggcccaccctttgcaccagtgtgtcctggatatgggacatagagtcaaggattattttggagctttaagatttaacaacaatcgggcatggtggctcacgcctgtaatcccagcactttgggaggccaaggcaggtggatcagttgaggtcaggagttcgagaccagcctggacaacatggtgaaaccctgtctctactaaaaatacaaaaattagctgggcatggtggcaggtgccttcaatcccagctactcgggaggctgaggcaggagaatagcttgaacgtgggaggcagaggctgcagtgagctgagattgtgccattgcactccaccctgggcaacaagagtgagactccatctcaaaaaaaaaaaaaaaaaaaaaaaaaaaaaaaaaaaatatatatacatatatatatatatatatatatatatatatatatatatatatatatttaatgactgccctgcagggtttaaaacttgcatggagcctctagcccctttcttttggtcaatttctcccttttggagtgggaatgtttatccaatgcttgtacctctattgtatcttagaagtaaatgacttgattttttatattacaggctcatgggtagaaggcacttaccttgtctcagatgagactttggactttgaacttctgaattaatgctggaatgacctaagactttgggggattattgggaacacatggttgtattttgcaatatgggaagaacatgagatttgggaggggctggggtggaattatatagtttaaatatttgtccctgcccaaatctcatgttgaattgtgaaccctaatgttggaggcaggacctggtgagaagtgtttggataatatccctcatggcttggtgctaccctcatgctagtgagggagttcttgcaagatctggtttaaagtgtgtggcacctccaccccccttgctcctgctctgccatttgccacactggctccctatttgccttctgccataagtaaaagcttcctgagacctccccagaagccaagcagatgtcagtgccatgcttcctgtatagcctgcagaactgtgaaccaattaatctgcttttctttataaattatccagtcttggatatttctttataccaatgcaagaatggactaatacaccaatcaagaaagtaaataccatccaaagggattaagattgactataaattttaaaatatgaacattctgaatttttcttcctgttattaatgcttaatgaagtcctggaaatgggaacggagaagtggatccaaatacatccacatctgcgtgtgctttttgctggggctttatctgcattctctctctgctatggtctgagtgcttgcatcctcccaaaattcatatgttgaaacctaatccccaatgtgctggtattaagagatgggaaacaattaggttatgagggctctgccttcatgaatgggattagtgcccttataaaagaggcccaaggaaacttgtttgccccttctaccatacgaggacacagaatgatggccccatccatgaggcagagagctagcactcaccagacaccaaatcagctagcaccttatcttggactttccagcctcaaggactgtgagcaataaatttctgtcatttataaattatccaatctaagatattttgttatagtagcccaaaaggactaagacatcccccttaatgactggagtcagaatcacatcaaaaaataaggctgagttggagccagcaacatttattcacaagagaaagacaggaattggactggctgcagagaggcccacagagtcagagaccatccacctcagctacagcacagggctcagcactgtatttctggtgttagtgctattctcaattctgtccctagttcctgctactgaggaactccatacacagcaggacagtcttctgctgtgccatgaattcaaacacaatctgtaaagacagtgaaggaagctacgtctgtgcttaggtgctttagagaattatcggcttgcagtaataagagaaatgtctgggctgggtagtcctcaaagactcccatgtggttcaagataacaaaatataaaggctgagcatctcgtgctcccaacctagttctaaggcgtctatggagggatagtgagtggggctctctatggcagtgattgcctctaatgaaggaaccaaaagccaggcagggattagggtgggcttctggttttagaaaacatgatggtagagctcttcataggaagtttttaagatcaaggtaggatcctgcttggaggatcgtagcctggcagtctggatcagcctggtggtggaggtgaagggtgtggaagctggactcactttggcacacaaagttcaggaatgagttgacaaccaaggccccgtggctatggaagatcgtatcacatgaccccaaagtatggcagggcagccagcggagcagttctacctctctaccttgggcctgcagggtgacatcaacattgataacattgaaggcatgatgttgtcaatatttattataagcacacttataatcttaaatttgcactttatcctagcctccgtggtgcctattgtatttatgggtgagtagttggaggtgacagaatataatctttcagttgcatttaaagttttatgtttcttaaagttacagaaagttcgttcccaggactggggctaatggctcttctcctgctccttacagataatgtggcacttccattgcctagtatggaaccaatatatcacatgaatgtgcacttacctagaactagtcttatatcaggaatgaggatccagggatccttgcaaagaaagaaataataattcagagaaaccctacactctcaggataagaagggggaaaatcaaggttcccgccatcaaccaaatggtttgagtccaggcagaatctaaaccatcactcacagtgcgccatctgctccagcaccagccctcctgattcttttgcaggtcagcaggcatgaaagagttaatagcaaaggccatgagaaacttgctcgctgttatagagaaatcacttttagttccagttgctgctgccagaggagatgcttgagagcaagataggaaataataaggaagaaaaggacttttgaatcacatgagagtcttcgaggactactcagcccagatgttcctcttattgcttcaagccaataattctctaaagcccccatgcacagatgtagcttccttcactgtctttacagattgtgtttgaattcatggcagaccaggagactgtcctgctgagtatggacttcctcagtagcaggaactagggacagaattaagaataatataacatatatgaaataactgtattccataactggaaatacagtgctgagccctgtgctatagctgaggtggatagtctctgcactttaaaagagagtctttgagcaactgcagacaaagactgatataacttcttgattagaaaatcagctgaaaggccgggcgcagtggctcacgcctgtaatcccagcactttgggaggctgcggggagtggatcacttgaggtcaggagttcaagatcagcccgactaacatagtgaaaccctgtttgtactaaaaatacaaaaattagctgggcatggtggtgcatgtctgtaatcccagctacttgggaagctgaggcaggagaattgcatgaacccaggaggcagaggttgcagtgagccgagactgtgccattgcactccagcctgggcaacagagccagacttcatctagaaaaagaaaaaaaaaaatcagctgaaaagaccagaagagaactccatgagacagggaataatggtgagccaggactattataggagaaacagatctgggccagattcaggacttcacccattccaattttagagaggagggcttggaatttaaggactgagcccttccaccatcactatccactccatgctaagagaacattaggtggcctctgtttttaaggctctgtgctgctgagcaggacatgcttgctattgaggtgggtaggatagtaggttacctataaggttccttccaggcagtaaagaaactgaagaaagagcaggttaggaaaagggagagaagtgttggtgcagcagccagccacagggaaaggaatttggtggccttggagggagggaaagtggggacagtatcttcagtaggattaacatggatttgcatttgaattgtaaaatgagaagttgcttagtcggatctcagactgagggtccatggtgctcctatatgtttctagattatttgtaatatgctgtttatatgcatgtatatgtacaaatgtaagagctcttagcaaacttaagcatacacacaaagacttaaattacttgtttaatacagtggtgtccagttggtttttttgtttgtttgtttgtttgtttttggccaaattctttgatgaagtcaaatctaatttgaaagttgaaggtctaaaacagataaatgcaagagctactgtgatcgaagcagacaaattgaggagagcaaaatcatttaatcaaagaggaagacgtgacccagctcaacttcctggtggacgacctcagctgtgctgttgttactagtgtctaacaggaagaggaacctaattacagctcagccacttcgagctgctgagcttgagcaaattatctcatctctctgaggattcatttcctcttctgtaaaatggggatatcagtagctagttttagataactgtgtgaggatgattaaatgatacaacatacctgaaagcacctagcataatatctggtgaaagcagtgaaagacgctggacaagtgtttgtttcctttctgcagccaattaagattctgggaaactgtaactctacccaggctttccagtagcttattttttattgttctattgtagtgcttaaataaggataacttttccagagatagcctaagtttctcatttctctggctcttggaatttccagtgcttcacaaagactttagtgttaagaatgtaaggtgtagcacagtatttcaataagtccccagttctacatggaagggagcagtgtgccacaaatgttcttggcattgattcacatttagatatacatttcagtcatgacatggacatagatataaaactgaaacaaaagtttcacgaaattaataaacataacgtgatgcactttttaattttttttcattaaaaatagactactggtcacaatcattaaattaatttcacaaacccataatgggccactgcccattatggattcaataaacactgtgtgatatgcactttgaaaacgaccactgtatttggatccagtgtgggagtgataagaaggaatatggactcatcaccaactgcccatatttttaggaccctctagagtgattttttttttttctgaaaagccagaattctaagattgtcatcacatattttcaccggaaattaatgtcattccttggttttagcttctctgcatagaacactacatgcctgagtttgtgttgccacatttgcatgggcacaaataagttatttttaccacaaatatttaaccttccagtttgaagctgtgctgtgcttagcctaaacagcatagagagaccaactgtgtttataattaaagaaaaatgctgtgcaaagccacagaaggaaggaagaggcaattcttgttggaggtatgtgtcactgctttcaaggggttccctgaggtgcttgactccacacggactctttcattcctgctaggttgcgaatactacaccaagtgctgtggacagagagatgtagatgaagcaccggcctgtaaagagtctggtgggggagtctgacaggaaattgttccagtgtaatagtgtcaatcatataattggtggtttcaaattttgtatagatgggagagttgtcagccttccacaggggagagggtggtgaccagagacacatgctgaccccacttgagcaggctcttggaaatacggaaatccttcccaataggaaaggaaaggttgaagatacaagagagggaggggataactgctgtgcgggctttgacctggagatacgtggcccagctcttctcacagagcacacaggatgctctgccctcctataacaggcacatcagggccccatctcatctttgtggcatatggaagcaaatgttactccatgggcaggattcagaggcagccatgtgctgctcttagtacaagggcagaggacccagcattaatgcagtgctttctatcacctttcccaactaccagaactttggcccacccatctgcctcctctctcccaggtctcttggtgcccaggttttctctgcatacttgctgcactctctggtgtcctggaagcagctctgccctcttccaacctggctcagccttgaaagggccccttttttcacattggtgcaggtaggtcttttgccaccatccaagccttgttcctattcttctatcaacttccatcagcttgtatggaacaacacatcccctccccagtgctctgctgtgcacattgaaactgcccttctcagatcagagccccgcccctgtcatcccatgcacctcctacatcccgcccctgactcttggatgtcgcacttctgttcagacttcatctctgatttcagcattagatacagaagctttttcctgctaagtcctctcctcccagatctaattcacagccagcaaatccagctgtgggcagtctttgagcatttactctaaagctctaaaggacccaaaggtgatgcaagagccacctccctccactcagaaaggaaacactcactgtgtccatttggcttcaatcagacaaacccaagacattcagagggatgaaccgacctgaaaaatatccctaaaaacctactttaacagaaagcacaaagtttcaggaaagaatggaagaaattatagaaactggaattatacaaactagtaggggcatggaggcatgcacacagcttagaagagaaggaagtcactctatctgcttcagtgtcatgatggtgtgagaccttgaccaagaatgtaaatttaaaccttctgggaaactttgctgtgctccagcagacaaagaaaaggaggctgaggaaagtgtcagagccaaggtggactgataggagggaggagcgtgtctaatctcaagcagcctgctctggtgcaaggacacagccaggaacactggaactcaggaacactgggacacacctgccaaggctgccagagaagcatttcatgggagtggaccccaaggccaagtcacaggaattgcagtcaagcaacatcaagtcaaaagacaggctgcaaggtaggaggtgaagacatgagcagaaggctggagagattgagcagagacttcaaagctggaaatcagactttagcaaatgagaggtcaggacaaggaagcaggggtatgttacagagcagacaagaggcagagcccaccctggaacatgttattcacggtgcctaccatctcagcctcccctgcatgcatgtacaacttcacccctaatatctgttgaacaagcagccctaaccaccgaggtttgtaaaatgtcctggccacaggtgattggatcaagatggggacatgctcccagaaagctgtttatgggctgtccagtgacttatgacatggcctggcaccccaaggtgggttgggtcaattagattatgccaccaaacttagaaatgtcagggaaatgaggcaatcatagttccttctcttgggcttctctaagaatccatttctattattgttccataagtactttattatagaacaccataagcactcccatctagactctcactgaactgccttgattcagcctctgttcccgtacaacctgaagactcaccagaacacgtatggacttgcagctgtccagaagcacagtgatgaatggtgtgtttggccactccatttgttttcacatagtttcccacagtttagaagtgctgaagatgagaccttaaaagagttggaacccccctgagtagaaaagaagctggaattagcaaaataacacaaataggcatgagattcatcctactgggaggaagtcacccttacaagaagagaagcacaaatgaggaggacccccgctcacttaagtgtaaaaaaaatgctgtgtttagaagctcagtaagatcacagttagtgacttttcccagagggggtataagaagtttcatggagacccaaaaggtctgatggcaagataccttcccaatgttgagtaaggcgccatagtctgccaaaactcttcaaagccactgcttctcatggacataaacgttccaccagaagtgaacatggtggtattttttgagtggaacaatgaaagatgtgagaatacaggtggtattttcattgcttcttcctactgccctttggaactctggaagactgaagaatatctaaagatgatcagtagtggacttacaagaataggttgatatttagaatgaggttctgaaacacagcttaagataccagaataaatcattctagccatgagtgcagagaatcttacaaagacatgggggactatgttgcttagcgactgatcagctgatctcatcaagaggatttaaaaactgataccaggaggaagagtaagacaacacaataaaatagacaacccacaagaccagttgctatgaatgacatccagtgggatgtggaaaaaaagggttccaggacaggaggtttccagtgattcacaggagataagattgaatcctagatgtaagtgatggccatggccttgggtgtcctaatgcatcctgcagagagaacaaacagaataacccaggacaatgatcacagccttgtagatataactggcacccaaacatgtcaacagaccacttagaagcagacagattaatgtgctatacatgcctgaagagctgtgtacctaacgttgaaagctcattgatacacatattgtgggcattagcagaaatgagcctgccagggaaatatgacaggtggagaggtgagactcctaaaacaaatcaaagcactagtacagagataaaaatccagtggtgagggagaaacccactgaggagatgtttcctggaagtcttctttggttaaagacaaagtgaaaacttctccagttgctttgctacaagtattagaatacttttgatgtaatgaacagaaatcctgacacaaactagattgaacaaagaaactgtagcatctggacaaagggtctagagataggattgtagattccatggttaaggatggggggttccgggattgtagattctgtggttaatgatggtatcaggaacaccagttcttcccaggctattgggccatccttccttcctttctgttcatcttcaggttggtcgcaagatggatgcaggtctaggcattgcatccagacatgaaagtagccacaggaaaacgcacttcttgtagctctctgttaagagcaaggaaaaaattattcaagtgcccagcaaactggctccttacacatcatggccagaagtatgccaatttttgaagcagtcactggcaaaaggaatgggactgtgtgggcccaacaggttcagccctggagatggatcccttcttctgggacaccaagaaaaacaccatccccttctcccctggcaatacccagccaaccttccagctatgactctcccccacaggcaccctgtttcttctcatgacaactctgcactccattatccacctcctgggagcaaaccattttgtagcctattccaaaaagctcaagccagcacagacaccacagggcagcaaacgaaatctgaatctcaaagcttgccagaccagcagcgcccactgagaaactctccagataagagatgatcccaggaaccccaccgcctcctgccatgtctctgcacatgccatcaacgctctgctctcagtgaaaatggctgaggggaggagcttttcctctacagacccaacgctgccatttcccacccctgtggtgggactcgaagaggggctggagaacacgtctccacacacatacagctgtggcctgcttttggctctctcctcccactcttctgcagcgcaaaccagggtggaggatggtgtcagacccgtctttcggaacacttgtcatttcaagaaccagagaggcaaagcccttcaggcatgtttggagtcccagagagctcagcacaggactcgtgctgccaacactgtgactctagactatcttgctgggaatcgggatttcagctcctctttccacacaccttcacccccagcactgggcacccacttctgcagctccccactcaaattggtccccctcctttatgacactgggcttctctggattcctgtcagccgttttctccagtcctggggctctcaatatctccaaatactcacatgggtaatgggttccttgacccaatgacaagcatctgtctctcaaagagcagtaggcctttcctagggcctctgccatcagctctgctgccctttgctgccctcccctggccattgacatcactgcaggtaactcttcaggactctgatgggttcattgatacatccattcaaaaaaaaagtatttaggggccctgtgtaccacgcgatgtccagacactgaggattcagtgataaaaacacatggcgcctgccttccaggagtacacagtctagtgaggaaaatgagagagagggagaaaagcagagagagagagagataatgaatgaatgagaatgagaatgaaagaaggaatgagaatgagagagaggactttttgaatgggaatgagtggattctggtgtgcccttgtggaagtctagatttgctcattgttctgcagacccgactgcctaacatgttcacctgaaaaggaatcccctggcctcccctttggaagtggagttggagaatttattttaaaccgaatatttctgagcaagtgcaaagcaccctacctggcactgaggtataatggggaaatgctggtcccatcccccacagaatttacaatctggctgaggaaatagacataagaaaataattagattgtttaataacagttatggtgttacctggtactgtattctgtcttagtcatacctagcaagagctccacacagcaaggatagggcatggggtccatgttttagggggtagaaggagtgaaccacagagagcacagcccgtgcacatggtaggcacctcaggaagtgctgaatgcatgaaagaggctgcgcagcagacaaggctcctgggagccaaggccagtgtctccagccagctcagctgaaatcagcagctcatgtgctccgttcttcaccttcagcatgcccacttcatcctgaaactctcttctacccaccacctcatctccagatgcagatcctaatgtcccagacaggactgttggcaggttccaagtcaagtgaaggataattcaagagccacagtccaatagtgcaggagccatatctgctctatttgccattgtatacccaatccttcacatagtacctggcacataggaggtactccataattctgtgacggttgttgaatgaatgcatggattttgcataactattcaggcaagagcttagcttctatagagaatttggtcatgattggattcatttgatcagtggaagcagccattccagtttactatagaagtaacattccagttactatagaagtagatttagaacctaatttggcctattggctacaaaaagggtacagactctgagttgtagtgagactgccagtctacctgcaggtcgatgagggctcctccatcctccctgggctgagatttaatagtgcctctttttgctcagcctgctctctaatcctcagggtgagagatcagtatgaactgacaggtctgagaaatcttcctaggggaggaagaagggtttccagctgcaaggagagagcagcgtgcagtgacagtgaggcaccaggatgtagaacaatgctgccagaacatattccctgaggtttgggaatgaacttcttcaagggctgtgctccctttttgatgggtcctagtgggcctctgtgctggtcgtgaccgacttttcttcaatgatccagtggaggctgcaatgtattttgcttaaaactacagctggtttataattttggcctcagacagtaattacagctgctggggctccttggagagataattacggaaagaattcagcatattcattttatctacacacttaaccatcaattaaatcattaccatctaatcctattccagagtctagaaatgttctgtgaatatataattttgaaggcactgaagtttgttttcagatggttttaagtgaaaaattgcccaatttccatagccaatggaggctttctctatgaaagcagagccgagagtatctcctggcttgtggttgctgcctccctgggggcctgcaccacataaagggccaagcaggaatggattgataggcgggagctgggactttgcctttgatctcccatggagtttgtgattttccaaagcaggattagcactgggacttagaggtcagtggctggagacagacaagagggtggcttgttttgccaaggagcttccaggagagtcttcccctgctgggattctgctagggccctgggctgtcatccacttatcaaagtcaggatggggtcttttcactttgggaacccaggagagagtgtggtatttaaaagcatgagtgctggagctggcttcactttctggctttgccatttttgagttgtgtgtccttgagcaagtttctaaattcctctaaacctcaggttattccactctttagcaacacaacaatagatcctacctcacagagctgtgtgagacttaaatgaaaaaatgaatgtaacatgtttaacacagcatctggaacttaatggatgctaggtaaactttgataattgatattattcaacatacatgtatgtacaagaaaaggagagaggcagaagggagaaatcaaatgtccaaaaatgtgcttcagcgggaaccagggcctctgaaagcatatgtggcatgggctgggactgcccctgggcttcactgtccagccttggactccacggctgctctctgctctctctgaccttgacttcccttggggatggtcgcctgggaacctctgactgcagtccccctctgtacccctcctccctgaccctaccctctcatggctccagcctggtgctcctccaaaaaccttgctgcactgctggtaccctgaatatgcctgttctcctcctacacttccaaccatccttttctctctttctcatgggctttcgctggctgacggtgggatatagtcatgcctcaagtttctgacctaagtcactttttgtttttttctacaccacacaaagcagcatctgggaagacggcccacagggatgcaactgcttcctggcctctttcagccagggaggcaatttttctaatagacaggagtcttgggctgaatcctcttcagactgttcctaacactggaatcccagaggcactgtctatacagtggggccctgaggaagtctcctctttgtgagctgactcttccagatggctgcactagtcctctggccagtgtttgggctcagacaatcctaccctactgtacacggtacgtggctcctgtgctgaagttactaaaaagcccagctcttgtagctggcatagaactggtcacaaggctggcttttgccctggcataagccgcgtctatgtgggagccccaagctgggaaccagccccaggcacagcatcaagtccacgtggcagacttgcctgaaaaacacccacttgaccttatagttgtgcctatcaccgagccaagggctgcaaaggaaatgaaaagctcccaactgctgaaatcatggagctggaatatcaagtctctatgttcaaggataatcatggttatcgttggaaggactgtacagtgaagattaatttttaacctcctctgagagttgtaagaattaaataagttaataaatgcagaacacttacaagagtgcctagtacctaatgtgtgctcaatggatattagctattattagtatcattattattaaaggagaaaccaggcttcatgaggtttatggagtcttggccagaaacactgattctcctgctttgagaactctcaggagggcttactcttgggctggtcctcctgtccagtgatctccagagccagtgacaacatgacaacttcctgatcccaaacattagcatgtggtataccacaggtaccacaggatggtcttttaggaacgtagatcctagcacttcccagagcaagggaagaaaaagccctccctggccatcccccccagcctctctgccttgattccctcaaggggaagcaggaggggatgcccacaagctccctctccagaggcggaagaccaataccctcatttctccttgcttctcctcccctcctcctggagaatgtgggtaggtggttcctgccctgccctttctgtctgtgagcccactttggtccctggtcagctccgcaggcctcctgcaatcactgctgaatcatgaatgatccactgggcagtgaggacccaatccctgaggggagcttgggagagaagcatgggacacatcagcatcgccagggctgtccacctcagggcccagaggcatacatcctggtgcccttttgcttcactatttgcagtttggcaacatggaagtgtgtgtgtctgcagagctggtgaggtcactctgtctgatgcaccactaaagctttccaatgttctggaagtgtctgattcggggtctgatcaatcttgccctcatatcgctgattctctgagcagggacagatgtggccaccttcctgtaccatagtgaatacctcagggaactgcctgcccccttcatgactcaccctggtacctcaccccaattctccatctttctctctggctctccgtggcttccttttataggttagaacccaagttccttagagggcacacagaggccttcacaacctgacccctctctatctggaggcacagcccatcactgcttttgaacattttatgccccggccccagcacacaggccacttctagtaccctggcaacactgctctgtggtgccactttgcttttgctcatgctgttctctttgtctgcgatagctacacaaagctccctcacaaacattcacttccttcgaactcaacatacagataaacttttctctgtatatatatctttgtgatagctcccacaatcctattttgtaattttgtgttggttttactgaatcaactatgagttccctgagaacagatactgtatctcattcatctctgaatcctgaggccatacagataaccttttctctgtatatatatctttgtgatagctcccataatgctattttgtaattttgtgttggttttcctgaatcaactatgagttccctgagaacagatactgtatctcattcatctctgaatcctgaggccattgtgtaggccccagcgtacaactaggtgcccagtgttggctgaatgagagcaagagggtgggttcagcttctcatttgctcagcatgaagtgtgcaaattccttcctgactcagaaattagggatccttcattgacagtcattgtatggtttcagaagattgcacgttcaaatgtctacactcgaaaaagctgaatgaaaaacaccctcaccaacagcatctcatgttttgcctaacagcatgagctctgcctctctgtaggggctttaagcaaagccttgacagtctgcaaggagagaatagccatggggctcggggtcccgtgaactttgggatatttcacaaatatcctaaatattgttgagacagtctagtgactttgtgaaactgaggagaaatggggaggccttctctccgaagggcttcagagccatctggttctatctgggatttattctgaatgcagcctttacagtgagagggcgccacactcaggtgcagggatctggcttgagacttggggaaaacatcattgcctttgatggcgcctgctaaaagcagtgtggacacagacacctcatgcacatcttctccgttcagggctccaaatccctgctgcggctcgcctcaaggcggaacggggtagcagcacacacctcctgttccaaggaagacagcatctgctgtgagtgtgccgctttagcaagatgactgtgctttattgattgcaatttcatgctgcgattatgcacgtcaatctacgctgaaaatggcaactgtgccccctgcatctccgatgttgtgtggtgtgtggttctgttttccagacatactgaaatagtttgaaaaagtggcaaaacctgctctacagagcaaaaagaattatcttaaaataactcacttttcataggccttcaaacgtcattctttagcagggcccaatgagtgaggggcagggtctctacagcttccccagagacctgaacccctcttttcagtcgtggcttcacggtggatgggtcatcactaaggatgagaaggctgccaggcccagttgactggggtggggcagattcagggcttgaggtggaaaggaaaactgggagcagcaggggcttagtcttcacagaatgaaggagggtggccaagggtgttgctgatggaaccagggaggagaagccaagactcagagggttataagaaagtggaggagcaaaggcatcaaggagcaaaagaggtcaggcatggtggctcacacctgtaatcccagcgctttgggaggccaaggtgggcggatcacttgaaatcaggagtttgagaccagcctagacaacatggcaaaaccctgtctctactaaaaatacaaaaattaaccgggcatggtggtggatgcctataatcccagctactcaggaggctgaggcacgagaattgcttgaacccaggaggcaacagttgcagtgagccagcctgggcaacagagtgagactccacctcaaaaaaaaaaaaaaaaaaaaaaaaaaaatggagcaaaagcgacaaccttgccaggccaccctgaggtgcatagatgcatggaatgtgagggactaagtggcctcttgagagtgctacaaagaaagtgttgtgacttcaaaagagaaccaggattcagttgaagtgagaaagtggatagaaagtttacatgaaggattaaggatgtaggggaggtaggtgtggagcaccagaggaaggctggagacagtggaagtgggggctggtttggagaaggggaagtacagggcaggatatgatgacagtagggacaagaaaagcaactggactgggggtgtggaaagcacagcctgccaggtttgatctcaaggggcaaagtctgcttcacccacaggaagcaaggtgaccaggctatcctagaaaataaagccacagccatcctcagaccagctgttctcctagagttgtttgagagagggcctgaactgtctctcctcatgtacccatttattcgtccattccccagtgtttgtgagcattgggtctggtgggcccctgctcttcccaccaccttaaaccctctcctgcctgcccaactaccaccccctcccctgtgcccagctaacttctcaactcctgtctgccttctccccgatgccagtcattgcccgcctcccaagcaggcatgctttgcctgtaatatgatccctccgatgaataataatccaatgttacattttctactctatccagaccactgtgctcagtgctgtacaggcatccccagtttaactctcaccctgtgaagtaaacagttttgtctccccagataaaagaagctgaggcttaactaatttatccaacatcatgaggcaaataactggccgagctatcagattaaggtagatggtattatttcttcatggttatatgccccagcacactcttgtcagggtcttgactccaatgacttaggactcgggcctgggatttgcttcaatcaatagaatatgaaaggatgacaacatgccagttccacatgtttctactcacccccttgaacttttagcatctgtcatgggaataacatgcgctggaagacgggggcttcttcagctcggtcctggaacaagaagacgcagaagtagatttctacctgtctggcagagctgcagccaaccacaaactcatcagcaagaaattagtgtgtattgttgtaagcaactaagatttggagttgttattgtaagaaaagctgacaaaatacagatttaaactcacagtgttcctccatctctgcctgttggacatagctaccaagcttatttgggtccaaatgcggacttacttctctccacctgttaggaaaggctttctctcttcattattttatcatcaagatgaatctcacaacctactggaattccagtttaacttttcttttccttctcttgccctctccctggaaaaagttttacacatgccgacacatgtcagcaaacctctcaacctcacatctgtgctggtcaagcggctttgaagacacagctataccagtcagagcacaatcagtttctgacatggtcagtgtcgggatcacacagtaatgctggttttaaaagacttttctttctcagctgttattattcagctcacttaacaattaaaactagaacaatgccttagaatttttaagaaaattcttttgtttccatcctgctggcaccgattcatcatcctttatgacttcacattcccaaatgatttgtgatgtaggttttttgctaatgtactttcagttgttttgcttctgatgtttcctccccacctaatcaaatgcttcaaaataaccataatttctaaacccagtaggacataggacatgcactgaataatatgcactaaaatttattaacagaaagccctttgtttttaaaactctgaaagctaatggaatactcttttttactttagaaggcatgctgtgttctgtgtggttttcccacagatgtgtttttaaatgttgcattctgttaagactaaatgttgtatttgcaaagattttactcccccaaagcagaacataatttccctcgctatcttagcttgaaaaggcctgaagtgaaaatgtatgactttgcttatgcagcttttcttctcctcttcagataaaagaaccacattttcctttgaggactcacccctcttccccctctaaccatgtggtttgggtagaggcatccacatcctcagctccaggaatgtctttgcatctccccaggcttaagcccaatcatcacattcagggattggttcggggtgagtgtgtgacccaatttaggcccaggaattttgttggaactatccggaaaagtcacatctttccactggacttgaagctgtgaggatgcaaatgtggggttgttggctgctatctcaccatcaaaataatagagtgcactccgggatggagtgaaacaaaagaaagcatacttgagaagtagagaaggtgataatgagtcctgatgacactgtctgaacctctggatccagctgtgcctgaaactgttccttgcaagggactagcatgtacctcatgaccgacaacaacaaatctgacattgctgctggttggattccaactctagagaaagagatagctagaaaattagtctgcacacacaaaagcagagaaaaaatacacaaaatacccagtggttaattttaaaatgtgaatgagcaatcaagggtcactaagtaagacagaactgacagcattaatagaggtttatatttaaaacacacacacacacacacacacacacacactgaggaaaaacaaacaatgataagaaatcaaattcaagtgtaaaataaatcaaaagtatagtaatcttaagtaattaacatgtagaaaatctactcacaagcacttctgcttgttgccacattggcctcaagtattagataagaatgtcctggctcccagaggccttctcactcctgattctgttccctgcagttctcctcactcagaaaagctgctctctgactctgtccactgcttctttcccacagaggtgtaggtacgtaagttggggccatttcaaaggcaatcttctctcatcctcttgtgcaatgtcttgagaggctgctctgaagaagttctaatttttgacaaagttttgcttctatacggtcaaaatgatctcactggggtttccacatgttgctcctggtctgtccattaggacagctctgaacgtccccttcccttccagagtgcttttgtttttatttttgccttacccatactcctttcagagagactggtccttagagcagaacataaattccatacaagatagcaatggagccagttgcccagagagctttgaacgggacagttatcacaccctgagtcaagtagaatgctttgggcttctaggaacagaaaacctaacccaaactcctttttatgaggtgaggttttgctcttgttgcgtaggctggagtgcaatgatgcgatctcggctcaccacaacctccgcctcctgggttcaaatgattctcctgcctcagcctcccgagtagctgggattacagtcatgcaccaccacgcccagctaattttgtatttttagtagagacggggtttcttcatgttggtcaggctgctcccgaactcccgacctgagatgatccccctgcctcggcctcccaaagtgctgggattacaggtgtgagccaccgcgcccggccctgaaactcctttaaagaataaaatgaggccgggcaccgtggctcatgcctgtaatcccagcactttgggtgcctaaggcggatggattgcttgagctcaggagttctagaccagcctgggagacatactgagacctccgtctttacaaatataacaaaaattagccaggcatggtggcgtgcccactatggggaggagtgggtactgtcagtacaagctgggaagatactccaaagtgtttctgtaacccctaggagccagccattggcttatctatcatcagttcccatgaccatcttcagttgtcctggtctctagcatgcacacattcattcagccagtgtttactgagccccgccatatgccacatgctattcccaacactgggaataaggtgttgagcaaggcagtgagtggggacccctgtgccgtggaggttgcattctggtggagggagacaggcaaattgcatacagttgaacagaaaataggtcatcacaagctggacgatgcaaatacaaaggcaagatgtgacagcagtgatggggcactcctttgtgctgggtggctggggaaggccctgagaaaatgacactttccctgactgaccagaagcagacagccaagcagaggcctgagaagtgcatttccatcacagagcagatggccagcatgcatctctggagcaaggaccagcgtggcctgtccagaagtagagaggaggcaggtgtggccaggaccatgagcaacgagaggtagagttgtaggagaggaggccgaaagggagtcaggccagggcgcagagggcatggcccctaagttcagatctcagtcgccctcctcaggagcaccagggaagaggccttaagcccagtctccttcagcaggcaccctctgtggtctcctcttgtttgacaggccagaggctcccagctggccaagagggctcagcttccccacagggcaggataccaatccctaagtccaggtgagtcgccccttttctgacattgctgctccccagtcacttttctttcctttccttgctacctacctgatttccagcccttgatgagagtccaagcctccagctcccagaatcacccttcattttaatactcaaataccctgagtccccaccctttctctctagcccttagttgatgtcttcctcccatttgtctctgcagtggcctgaggaatggtcttttttgcatctcatgattccagatgatgcttaccatttccgctctctgctgcactccaggcttctctacagccatctttagaggccttcagctgcttctcccagccaccatcttctccctgccctatccccacatcctatcccaagcacggacacagtccctttccccattcccccaaagcatgcaaatgccagactatagcatttaatgaagatttcctaagggctggggataacacgagtgaagacaatgcgagtaactgaaattaaaaattctatagccagggaaagaaacatccatctaatatcataattgtctctgccaataggaaactgcctacggggaacacattttacattgttatgcagaataacacagcctctcattctgagattggacctgggcattacctttaataacctaaggcccctgatacctccccaaagagctgtttccccagcaccccaacacactgtcttgcaggtggtttcttcactagggtgccaggatgaggagatgtgtgaagctaaagtcagctcaaagtcagctttctctccactcaccaagtggtgagtttgcctggaggaggcttctgtttctaagtcacacaaaggcccaatgctaacagcatggctgagagatacatgccgtggcctactatcagccacagtgtatagaggacagcagatacacagatgagagaaaacgaattcagctaataggttttatttgttttgacattgtgagtatctttgagatgaaaagctaatagttggaatagtgccaaaaatcttaatattattaataacatatcaataaaagcctctaaacctttaaggataaaagaaagtttcttatcttgtatcctcttttcaaacacatttaagggcctttgtttctgtctctttcactgagaaaaaaaaagcaagctgcaagacaatacattttctaaaattagcacacatttaattgacttttcaaaatgaagttctattcaacctattagatgtgtatattccatacaacattccaatgtttaagctatttttttttttttttttgagacagattcttgctctgtcatccaggctggactgcagtggcgccatctcggctcactgcagcctctgcctcctgggctcaagcgattctcctacctcagcctcccaagtagctgggactacaggcacccgccaccacgcctggttaatttttgtattttttttttttgtagagatggggttttaccatgttgcccaggctggtcctgtactcctggatccaagtgatccacccacctcggcctcccaaagttctgggatttagacatgagccattgtccctggctcatttaagctaattctgagactttttcccaaatacagaaaaacacatctgtaaatcaccattggagaaagaaaggagaacgtgaaggtcctgggaaaggggtgaaggcccctgcttgaggacttcatggggttggtacttagtccctcatggtatcacaataggctatgcattctacagctgctctttgtgacctgtgtaaattctgggcaaaaatggcctttccctgggtcatgtctgctaaagcaagtatcaccatccagtcagatggggctgatcccagcaggtgcccaagaaggaagtcacccactgtctaaaagtcctacataatcctcagggttcattttaggtgccacctcctccatgaagtttctagtgagcaatgccccatttggaatgaagtactcccttaatagtttgattgtatttagattgtatttgattatacatttaccacttaccacctctcatttttattttgtagttagttggatacatctgtcttctctcctgatgtgaactctttaggtctggggcatagggtctgtcagtacccactaaattgactatttttagttgatttggacttactgcagaccttttactaaacatggcaattgagcttttgctctctgatcatggagaagtttccagtatgcaatagtcaggaggcaggagggggctggtcagtgtgtaagtactcaagggaggattaaaacaaggtacagtctgcacacagctcctcacagtgggtggaggcacccagaggagagaggcaagctgcctgcacatgcagcaggctggttacacctccctccagtgtcttccccatgtcaggcaaatgagagctagaggaccttgggatcttgctctttagccagaaaatggccaccctccataagtggtaatggtgatatcctgaaatcaagttcacaggtgaacagatctaatgtccattttattgttcactaaagtttagggtcagttgagagtgggtgataaatatatgactcttcattcattatctctttggtatttatatttttgacttattttttcagaactccattggtccctattcaggaaatgctaaatttaaacagccccgtcctgttttgggaccagccacctagagttctcaagtgctaaaggcaacgacctccttcccatcctcactcaccagtaattccacagggccaggctcagtgagatctgtcaaggcaagaggggtgcttcagctgatcccatactatcactcaattctggttttctgactctcttatttgttttcaatccaacctctacactccttcaagtactaaagtacaaatctgagcatgtaactctcccacttaaaaatccttcaataactgcccttcattctgaacaagatcaagatcgagttccctaccttggcattcaaggtcctctgcgaccctgcctccatctcctccttatactttatgttggggccacacctaatggctggtggttcacacagtgctttctattcacccccatgcccttgcttctgctttaactttttcttgtgctgtcctttcaacccctcttttcctgcctagatccagcctgtctttttagcatctaatcagttgtcagcttcttcaggaagcattctgaagatcctgtggtatgagctaaatgcttctcgtctgtgctatcctctcctagcaccctgtgcctgcccctgacatagcatttggtgccacttgatattatctgtgtgtgtgtcatccccagcacctcccactgctccttgagaatgggcctaagtgttattcatcattgtataacaagcacctggcaaaatgcctggcacaaagtcagcattgaataagttcttgttggacagaatttcaatttcttctatcttacaacttgtaaaatgatttttacaagttttacttactgatttcttagataaattctccatgtcaatttttcttcaaatctacaggcatagtggttctattaatgcaccaaagcaactgagagctagctctgaatgccaaagagccaggcaacacccatgagaatgaagacagtggcagtgaaggtcccagtcatcatctcagatggatttgcagtgtcatgagggctcaaacagttctcataaaggtctttataagagacttaccttagtttaaaaggcaggttgggaaacccatgaccatttcctccagaaagcacagaattcctgcaagcctggggtcactattttggctgccatgctgtcagcttatcccagcaatctttcaaggtgcttcactgtatggcatcatttgctgtattgtaagaattctgttcaagtaagaatcaatcaagcttcctttgaaacaatcactttgcataaggaaatgggagtttcaaggatgtatttatttgttcaacaaatattgattgaatacctactataggtgctgaagatacatttttagggacaaaatagtcaaaaatctttgctctagtgaaacttgactagtgggagacacagatgtattatgttatagtgaaggtaaatgctatgaagaataaaatagggccgggtgcggtggcgcacacctgtaatcccagcgctttgggaggctgtgatgggcggatcacctgaggtcaggagttcgagactagactgaccaacatggcaaaaccccttctctactaaaagtacaaaaattagccgggcatggtggcggtcgcctgtaatcccagccactcaaaaggctgaggcaggagagtcacttgaacctgggaggcagaggttgcagtgagccgagatcatgctactgcactccagcctgggcaacaagagtgagactccatctcaaaaaaattaattaattaatttaatttaatagagcaagcaatggggatcagaagtgtgacatagattgtttactttttacagggggttaattttaatggaggtaattgtagggctcacaaacaattgcaatatttgagcaaacacttgaaggaggtgagggagcaagccctgtggccatgcagaaatacacgctaagggaacggccaatacaaaggccttaaggaggttcacacgaggatagtgaggagagtaatgtgggggatgcaggagagaaaaaagagagagaagtaggggatgagatcagaaaggtaacagcgggcagagctcaggtaactggaacccagtagagcttcaaaagtactttggctcattcgccaacatggcaatttttaagagagatgtgacatgatccaaagttatcactgatctctctgctgctgtgttgagaatagactagataatgacaaggttggacgtgagaatacccattaggagtctactgctataatctagatggcaataacagaggcttggacagtgtagaagcaaggaacatggtgagaaatggttacattctgggtatattttgaagggagacccaatagggttttctgtagggtatgagagagaaaagtaaaggatgattccaaggttgaccgtggaaagatagagctgccattaagtgagctcaggaagactgcaggtagagcacctatgtgggatgatcaggagttagacctaataggtttgaagcaactattggatatccataggaaaacataaaatagcagttagatgcaggaatctagagttccagagaaagatcaggctgtaaaaatggatgagatgtaaatggtaaagagaagaggtcccaggactaagaactgggacattctatttaaaggtaaagaaaagaagagaaaccgatagactgagaaggagcaagtcattgaagtagtaagaaaaccaagagggtttggtatcctagaaggcaagaaagaaattgtttccaggaagagggaatgcccagatgtgacaaataagatgtaaataaaatgaagattaagaactgacattgggtttaccaatgtgctggatattggtggggtactggtttgaatagtgtcctcccaaaatttacatctacctagaacctcagaatgtcaccttatttggaaataaggtctttgcaggcatgttaagatgagcttatgctggatcagggtaggcaccaaatcccatgactagtgtccttataggaaagccatataaagacctagagggacatacaggagactgccatgtgacaatggaggcaggaattggagtgatgcagctataagcgaaggattgctggcaaccactaagagctaggaagaggcagggaagacttctccccaagagctttcagagaaagcatgggcccactggtaccttgacttcagacttctagcctctagaactgtgagacaataaagttctgttattttcagccatccagtttgtgatacgtcattatggcaaccctaagaaactaacacacttgacgaagcagtcactaacttgtctgtaccttgattttctcatctgtagaacaggaataaaagtacctgcctcagaggattgtggtaaggattaataatatatctaatattcttataatagtacataccaaattctacataatgttaactgttataatgattatagatctaataattctgttttgaaataaaaacacttttttcacttgttctttgctaaattctcattagcttattaatttgacagattaaattttcctaaacttttaaacaccaattttacgtttaatcaaattctcttaaatatttttaaatgagaaaaaagatataaatctagtgagtaaaattctcctaaatttttaagcattgtttaagcaattgattaactacatttctgtgaatatttcaagctaaaatcacaaatttaaaatgtgattatattaaacactccaaacatctaatgcaggtgttaaacaaaattgttctcaatcatgtaactcttataatgctaacaaataaaatcttatacatttaggtgaaatgatgttaagcatttcaatatcttaaaaataagctttataaatgtagtataatagattttcctaagcatttaaatggtgactataaatttaactagttaagttattctaaatatgtccattaaaatcatgaatcttataattttctagtgtatcagattgttaagcatttagcttaaaaacaaaaattgggataacaacatgtgtattgcacttgaataaataaagtttacacaaaagcatcatttataattcttatttgttaaccctttctgtgtcacagttactcttctaattactaggaacacaatgatcagtttaggagctctttctaggaattgaaattacagagatgaccagagatttgagtcccaaattgcagaggtagaataaccgtgcacagacatgggatggggcattggttgcctcacaggggaattttaccagagctatgaattaataaggcaagtttcttcttctggttggcttctgcttgctgtactgtcagtgggagacaatcctaggctttttaatggaattttattttataacccagtgcatcacatatatcctaggaatctttccaatttcacccttatcgaatttttgttataacttttatcattcctattccgtgatttgggtagatggaattatggacacacacactcacacatagtagtcacagagcttcctgctgagacgtccttttattctgtgttccttctcttcatccttgattctatagtcttcttttgaccacactgagcccttcaagaatagaatgtgcattatttatctttgtgttttgtttgtttgttttttgagagggagtctggctctgtcacccaggctggagggcagtggcatgatctcggctcacagcaacctccacctcccaggttcaagtgattctcctgcctcagcctcccaagtagctgggactacaggcacccaccactacacccagctaatttttgtatttttagtagagacgaggtttcaccatgttgaccaggctggtctcgaactcctaacctcaggtgatccatccgccttggccttccaaagtgctgggattacaggcgtgagccacagcgctgagcataactttgttttcttagggctcagcacaaatgcccggtgctcaataaatgtttgttgaatgatgaatacatgtaatgaatattaatttgaagtaacagactccaaacatcctccactttacttcatcaggtagagtaattttggccctatagtaatttcctatcttgccacctcatcgaaaaatatgacagtccttgtcttaccttctgaatggtgccttcactgtagcctttgcttcttgattgtttctaatgagcccctctcagtaaataacaatctacatgtcacacatgccacgcaccatttgccacctttcccctcaaggtctacttgacggtgaatcttaacacactctcctgtgaagtctggactgttcagaattcatttctggactaagaatcctttctagaaaggtgctgtagtggagttaccattcaaagcacaataatttaccattctgggcatagcacttaagagcatacattttaatccataaaagcatggtggcagattctggctctgccatttactacctttattatttggcctttttcagactcagttacctcactgtgaaactgtaattgtaatatctatcacagagggttaaggtgaggcatgaatgagataaggtatgcaaagctcttaggatagagctagtgcttaagcactcaataaatagtagttgttgcccaaatggaccctttcatttttccatgctactggcccaatctcctgaaaggcagtatagtcacattcatactgctttatttctttaacatacttgttcttaaagccgagagaggaagtaaaaaaaaaatagaatgtcctctttacagaaagaagctaatcagattgtaaactggcagcgcgtgataatttttcatatatttgtaaagctgtgctaagcaacagtcaacaaaatcagattctaaaccagcagagcatgatgaatcttcatatatttgcaaagctgtggtaagcaataaatagtcaacaaaatcctgagatttttgtgctttttaaataaaattttaaatgtaaatttaacaatattaagtacataataagattaaatcatgtaataagaatcacttccatttttgacaagcttcttagttcagagcccttaggtacttcctgtaataaagtcccattttcagattcacagagagatattatctaatgtttcactctgtcttttcatgttcttaatttggggtctgtttcaatggcctgtctcatatcagctgtcatttttgtgatcgaaatgtcacttcacattacagttttcattaggacagttctcatctttggtttcaattcaatttaattcaaattagatccttatgtctcaggacaattgaattcacttacaatcttctctgttcagataggattgtaaccactacttcctgttgatactactggagttgttggtaccttctaaacccctggtactgcctgggagcccaccaggtctcataacaaggacactgctgcttctgcccatggaaatggggctggcaccagcactggaaccagccaagctagcattatgctcaacagttattaaaccaccgttactgtctccggtgttgatgactgagtctctaccaccttcctctcaacaaaatcccactgggtcaatgcttttctgaattatggaaaaatctttcttttctcacattttgttttatacaatttttggctgaaaaacagctcactaggttataggagtttggaaaggtgtaatttgcttattttgtttgatttggttgagattttctagtcttcccccaacagaagccagacaaaagggggctgaacaacaacagcaaaatttactcatgtcttctcctgagacaactttttcagaactgacttgtatgcttgactttccctagaataagtttgttttcaagaggcttttcttgcaatattgctggtagcaatgaccctatcacgacaccagatgtattgaaactccttaatcctgtcatcttgtgggcttggtcccagctcacaagcattctaggaccttagtggcgctgtccagaagaggaaaagattcagagcccagaaaactcacccaagtgaagggctgcaccttaagaagggggagaccagtaggctgcaccgccgtatttccagaggctgaccttgattctggctaattacacacacaaggaaattcaccaaatgagcaaaacccagctatggagttcaggtgggagctgtgctatgacttggccattggcaacaatgccaatgctagtggtatccctgggtatggggactggtaaaaaaaattggctaaggttgcagcctagccctctaagcaggctttagacaggccataagaaatcaggtacagaggtggtccctaaggctgggtactttgggagagctaaacccaaagcattctgaaggaactgcttaaatgaagaggtaaaattaggtcataatagggaaaaatgaggttgtgcacagaactgtgggggcaaacaagatacatatgcatgtcactagctgggggaatccagagaaatgggataagcagctaggaaaccataagtgggatgtggcacctgctgtatgctactagtttggactagggttcttaaaggaagctcatctggctagatttagggagtctagaaagccaaggcagataaagtacttttaatacatcagaaatgtagactggacctacagagggaattgacataattgctaaagcttggactttgaaattggaagtcttgggtttaaatctcagctctgacacttagtcacagtgtggccttgtgcaaattagtgtctctacaacgctgcatcctccattaaagaaccccacggggtcttttaagaacttgtaaagtccatatcccagtgcctggcatacaataagtacccaaaaatgaaggaatatgggctgataccatcacaactaattccagaccacattcattggtgacactgagcctgttaacaatttgctttctctgatgggaaggaactcaggaattggcaaactgatatgggtatgggtttcacagttgaaagagcggctagggaaccacgggcctgatgtagatggtggcttagaaagtagagctattcggggccaggcgcggtggctcacgcctgtaatcccagtactttgggaggccgaggcgggcggatcacgaggtcaggagatcaagaccatcatggctaacacagtgaaaccccgtctctactaaaaatacaaaaaaaaaaaattagccgggcgtggtggcgggcgcctgtagtcccagctactcaggaggctgaggcaggagaatggcatgaacccgggaggtggagcttgcagtgagtcgagattgcgccactgcactccagcctggggacagagcaagactccatctcaaaaaaaacgaaagtagagctatttggatggtgctccagggtagcagctgatctggcaaactgatatttgaaccacaatattaagacaaatatcattcagtctttcttcctagacacagaaacaaagacccctttcccagagatgtgtgtgtgtgcccacacacatgcacacacttcaaagccacgggtcacaatcaaacgtggtttccctttgcagtgaacacactggcttttaatactttccttaagtaagttatagcctcacatgtgaacttttgatctctgaaatgaagtccataaatttcattgtcagaatggttgctactcttttatagtttacgtgtaaattttgttattcctatatccatagaagtcacttcagttttttctctctatggccacagtattactacatttaatctgtgctggaaggtgccctgagtttaaattaagttgaatgctgggctgagtgtgaaacacaagagatactgctagtctaagtctggggcttccttaagagagcccctccttcacatctcggaaacaaggaatgatgttgcaccactcagacctcatctttccatcccagctgtattagtccattttcacgctgctgacaaagacatatccgagagtgggaagaaaaagaggtttaactggacttacagttccacatggctggggaggcctcagaatcatggcaggaggcaaaaggcacttcttacatggcagcagcaagagaaaatgaggaagaagcaaaagcagaaacccctgataaacccatcagatctcgtgagacttattcactatcacaagaacagcacggggaagaccggcccccatgattcaattacctcccctgccgggtcccttcccacaacacgtgggaagtctgggaggtacaactcaagttgagatttgggtgggggcacaactaaatcatatcaccagccttacctccgaccacttcattcctcacactacagtccagtcacaccaaattgtgatgattccttcaatgcaccatgccctttattgcattctgcctttgcacagtctctttcctctaccccaagtgacccttcttctttccagagggattcctcttcagcctaaatggcttagctcaagactcatcaatcagaatgctctctatagacctcctcaatccctttgaagttactttctcccttcccattgcccctgcagtattctatgcagcttctcacatcataatatctccatctgtgagccctttgaaagcagggggagtgtcctacttatgggcttagtatccccagcatctattaccatgcctggcacttgtttggtgcacattaaaaatgtatgaatgggccaggcacagtgactcacgcctgtaatcccaccactttgggaggccgaggcaggcagatcacaaggtcaggagttcgagcccagcctggccaacatggtgacaccctgtctctactaaaaatacaaaaattagccaggtgtggcggcgggcacctgtaatcccagctacttgggaggctgaggcaggagaattgcttgaacccaggaggcggaggttgcagtgagccaagatcgcgccactgcactccagcctgggtgacagagcaagactctgtctcaaaaaaaaaaaaaaaagaaaaaaaatgtatgaatgaaagccaaattatttttttgttttttcttcctgcagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaactccaaccttgtcttatttaacttgggggaaggggattctccaatgtcttttccaggataaagaaggaaattaaaataccatgaaaaaatggacatggcagtagaaaggaaacattctgatcagaccttgggaaaagctggtgccgagagagggagaggccaggtgtccccccacccaactggcactgattctcagccccttcctcttacttctgttggcttcaaggagacctgcccttgatgtgtgttgctgctgaagcaccctcccagccagtgagttggacatatgcagcaggcactttgatgtccaggaagtacactggtacatgacaggagcaagggtcagggaggggaggggaaaggtttctacaatgcagatgttttcaaaattctccaacaatcatgactctaaatggtatgatttagggctgggtgcagtgactcacacctgtaatctcagcactttgggaggccaaggcgggaggatcacttgataccagaagttcaagaccagtctggcaacatggagagaccaccatctaatttcaaaagagaccccccgcccccccggctaatttttaaaaaattagcaatgtacctgtagtcccagctacttaggaagctgagataggagaatcgcctgagtccaagagcttgaggctacagcgagccaagattgcaacactgcatttcagcctgggtgacagagcaaggccctgtctctctaaaaaagaaaaaaaaaaggtattgtttagttcacatggccatcagtagaactacatttcatatgatgagaagaaaataattatttattttacacttgagtcagggagactgacaaaggataggtatggaaaatggcttgctattttcatggccaccctgtcctgcaatgcggggggtgggaggggggacattccaatgacttactgctgcatgacaaagcaccaaaacatagtggcttaaatagaaatatattgtctctcatgattatctgagttgactgagcttagttgatgctctcccctgcagtctcatggttgctctcagatggcatctggggctggcatcatctgaatgcctgcctcggatggatgtccataatggcttcttcactcacatctggctctggaattgagataactggaacagctgcagaatggctggacatctctctccacatagtctctccatatggttagttcgggcttcctcaccacagggacatctcaagatagtgttctgataaagtgactggcttcctccagagctagcattgcaagtggtccagctagatgctacaaggttctgttaagtaagttctaaaggaacctagagtcatttctgccacatactagggtcaagagcaagtcataatcttgaatcagcccagattcaacgggaaagaaattacacaagaatggaatacgagaaggtgtggctcatcagggccatctttggagaaagtggggatgggagtgggagtggggaggttaatgagttaaagggcttcctaggtagctgtcattttaaaagcacatcgaatgctcaacacacatggagaatgcaatgagtaataaggggtagagaagaagggaagagctaaactggacagttaaacagtataagctaaagaaaagcaaccgattctgactgatacagtgcttatgaactttcaatgaaaacaattttatgcaaagtaatttaatgaactgagaaaaggacactaatatggatgtgaatatagccaaaaacaatgtctactgcctgtatgtggctcctgataattctgcaggccacttagctgcccctggccacccacttcactgatagccacctgggactattgagggtgtctagcttaggagtgcccagcctctggtattgccattcaaactcaacccagagaagaaggctcacctgttgcttactgtgcccttccacatccttacaaagagtatctctctcacacaggagtcctgagttggttgctggcacagaccacaaccagaggctgagtggccagtgaaactcctctgagactcaggttttctctctaatgggaattcctgactcttccttcttcagtcctctctcgggaccaaagaggaaggacacccctcagtatcctttggcaatcaccgtggacacttccgcagctatagaggtgttgctttgggatcatctaagacagagtcaagcctttggcaatgttcaggaaatgctggtatgtctctgagatcagctttcaagaggagaggcatgttatgaatggggcctttctgggatagcatacactattctttgttcgttctttctttctttcttttttttttttttttttttttgagatggattttcgctccacttcaggctggagtgcagtggcacaatctcggctcactgcaacctccgcctcccaggttcaagcaattctcctgcctcagcctcctgaatagctgggattacaggcgcccaccaccacacccagctaatttttgtgtatttttagtagagacagggttttgccatgttggccaggctggcttcgaactcctgacctcaggtgatccacccgccttggccttcccaagtgttgggattacaggcatgagccaccacgcccagccccactattctactttctatcaagtgcattccaagataggctgaccttcatggaagaagtgaaatagaaaactgaggaaaagaaaataattggaaaaaaagtcccacaagtcaagaaagtaccccaaggaagacttacaggacaacttccaaggcaaatgggaaaagagaacattggcaatctaggagctgcaggagagagccctggtcttcatccctaagcccaggatgaatgtgaggcaaaaatagtctctgttcttttggaggaagaaaaagcgagtgagcaagcaagcaagagagagagaaagagatagagaaagaaagaaaaagagggagggaggaagggaaggaagggaaggaagggaaggaagggaaggaaggaaggaaggaaggaaggaaggaaggaaggaaggaaggaaggaaggaaggaaggagcaagctctgagcagtgccacagacctgcttccagtgtccctgatataaagctctctttgctcagtctcccaagagaacagatcaagcttctcccaaggactatggcaggaacccacttccttcttccactcaaaagacttgtcacttgctgctgggatccctgggcatatgggctgcaaaattcaactagctgcgtgatcacctctgtcacctcactccctggtgtcttcccacttgtgtccaggagctctgggcctgggaaggattaacaacaaagattaaagatggcccacaaggcctcagaggatcaggagccagccctgaagtccagaaattttgactaagcctctgtcattagggtctcccagctcatccataggctaatgccaaactttcacaacagctagtggttctcatgacacctcctcctggtagaaaggaaagaataagtcaaaaggacctgggccacagattctgtcctcttgagtcattgattttgcctccctaaactatatcttaagatagattactctgtgaaagctggatgaccattgccagacaatttaaaaagtatatatatcaatatgaaatggattgatgataatattgcatattatagtttatagcacatggatggtattgcttttatccattttctttattttttgaaaattgaatttgtgattttaaacattaaagataatagaaaaattaattttttggctcaatactagatttattatagctattattccaataatttattcattgaattaaagttatttcaaaaccatttgacataggaatattgatagtttttttttctaccaagtgaacatcatcttcaagacattcacacaatttagataaaattccttttgcacagcagctgtatccagaggcttgatcttggatttagatttaaatttatcaaagaaaggcagtttttaaaatttgcctaattcaaagctcaaagactaatgaaatcctttcttcaaatacctgaagacatttgtattcagggctctagagatgagcttatgaactctataaacaactggtaagtaaaccttccagaaacaagttttacctttatagcagtacccttctctgctggtaccaattatccctcctaaaggactacttctatgtgtgaagcctcagtgggacccattgcccctcagtgggccttttctggctttgaaaagaaaagaccccagcatggtcctcaagtcttctgatgtttatataaagacggcaggtccttgtagaagtgtttatataaattaggaaagattcccccacctaccttcaacttatgaccttctttgactccagggaacaaggaaaaatcactagtttgggaaaggtagctttcagtcttgaagctgtaattatacaggggttaatgactgggaaggaagattaaacttttactcactacttgaaattattctagtgcatgatctcacttctttgggttctaatcctaaattatttgccctattctggtagttggacatagtggtggagaccagctggctcctagaaagtacaaagggaactccacccagttaccaccaagcacagtgcaggttggagacagccttttcctgaggtggggctgaggacctgctctgccactgaccaatcctgtgatttccaggcctcaccttcctagacactctctgctgtcagggatcctgccagacacttgtcagcccctggtgcagccaggtcacggccatatctgagggataaacagcactgcacctgtgactatacttggcttctacccttctgggcttaagaggactttggcaatccccaaaggactcagacacagcatgaccatgggaaacccctgcctagaacttcctgccttggcccagcccatcactggtttttacataatggtgcttggcatttctaggccactgtacacatatacacacacaagcacaaatgcaattattgtgcaggaacagctgcaaagaggctggtgcagggctccatgtccttcctgaaagtggctgaggggagcatggtcctaccacagctgggagacttgactttgtgcatccctttatagaaagaagctctctgactcttacagaagttgctgcatgggaatgccagagataaggcacctgcctacctaacacagtagtttagtcttctgagaagcctcctgtctcctttgatacctgtgaccctcagtcatggcagctcctccatcaatttatccaatgtgaggatggatgacactcacctccataacccagtctgcagccaggaaagtgtcagtagaggtgaccccacctttccaggcccatcatatgtgggtcaagaaaggatcatgtccaagaccacagcattaatgtttaataaggcttccatttctattgaaaagttgtccttcacctgcagtgtttgcaactgattgctagcctgaggaacactgggcaagaccaagatgcatcatagtgtggtggacagagccatgagctggggctgggtcccagagctctgctcctgccgctgaggctgaaaccacccctgctggtcacagtttcttctcacatgaggaagggttggcctactatgttctatgctcttccacctctggtgtctgtgtgtctgtgaatctagggaactgcttgtgcccagcactgaggaaaccgggcacctggggtgggatctatgcaatcctagacacacgctgccagaaatccaagcacaggctaactctggagggtaggttttggtgatttccacagacatcagccgtctctttaccccctccattgtttcttagtttccccttcaatgggttttcatttttaataaatggaaaggaatttgactttgagattgtcctgaaagcccttgtaatgaccagtgatgtctagcatggattataaaatgacaactggcccactaaacagaggaaattccattttgagttaaataccaaaataagttctttcaatataccctaaagagttcaccacagtcctacaggtaagccagatggatgagaggagggcagcagaaaggagagcctcctggatggggagcttgtgcacagagaagcaggtattagatgaagaaaagacagaaagacaatctgtgtggttggttcacatttggggcaggaaactgggacccacagggagggtgctgggcccctcctgccctagcctacttctttaagaaccaacctgtgatccctcccctagggcagtgatagaaatcttcatcctaggaagctcatgcctctgtccccagttcatgccactctgtgcttctgagaacatcaagacagaggtgtctggagtatcaaaagcaaaaaccttccttctccacactgcatggctcacacaagccagtgctgtccacccaccaggcctgtgtgtgcaccagactgagacgtggatttccagggccctgacgctctattgactgcaagaaccatcatgcttgtatctcagcctatgtttttgaaaatcaaactacccattccattatccatttagcaagaatatcaatcagacttattgggtgaggaggggagaagggagaaggtttgtgggcagtactttttctagatggaatacgttctcattcaagtctaaaaaggaaaaggactagtaccttggtcatagtcagatgactacctgaaaagcctctggcctttagtagctaaaggctctgaaaccaatagtttgcacaaacattgacccaatattggatctaggacactgaacaaaaatcacccaaggaggaactctctgggaacagcaggtaacccctcagctttatgtcctagggctccgttcccaccagaaaaaaaatgtttatagaaccccagagacctaacttgggaacctgtgcagcacagaccaagggtatgtcctatcctggggagacacagagcccagagaagacccagccttcccacccatgccagccagccctggccctggggtgtacttcccttcacctgcagggaagaagccaggtgaccatcaagcaacatgacatcatttcctggccagcaagccttctccagctgcagccacaccttccatacctctggattcactaatccacatcccacccccatcagcagctctcagtaatcaatcagtccccttccctgtaaccttcccactattcactcccagggcctccccaagctgtgtggatgtaaacaagatttcagaagcccttggcagagatatggttaccaggtgctgaagaaacagagactcagagtaggccacctgagcccacccagccacacctggcatacccagcatttggctagtgccagttaggaccagatactcagcctccagggagaataagttcataggaaacttcccaagtgagttcaaaagccaaaccagaatgatcacagtgagaggtgtgagcattctagggaccccggcgcacatggttattttaaagagcagagtgaggccattccaccaagtgcatgtggggcaggcagctgtcccatcctgggggctgtgggaaggcaggaccaggctcttcacttcaggcagagaatgcaccactgctaatcactgagagatttcggaccacagggcatttccagtaaagcatagggagttgagggagaatgttcagaactgagaagactagactgtgctctgagtagactgaggctaagagtgagcaaaaagggtaagaagaggtgaatggctaggtgcagtagcagatgcctgttgtcctggctactcctggaggttgaggtgggaggattgcttgagcccacgagttcaaggctgcagtgtgctataacagcacttgggaggagccactgcattcaaacctgggcaacatagtgaggctccacattgaagaagaaggaagaagaagaaggagggaagaggaggaggaggaggaaggagaaggagaagaggaagaagagattggaggaggaggaaggaggaggaggaagagggaatgggggaaaaggttgcattttggggaacttctcacttatgtcaaatcataggaagcagaatagactagaaccccctctctctccaccatgtgagaatatagtcagaagtctgccatctgaaagccaggacaaaggtcctcaccaaatctgccagcaccttcatcttggtcttcccagcctccagaacagtcagaaataaacatttgttgtttaagccacccagtctatggtatttcgttatagtagtctggacagactacgttggtgacacagcaaactgtgtgtggagatagaaggtaactaaatgtatatctgacaagaattggagatatcacaagtatttacttatgactgtcatttttgaccgtcaatgtaaacaatgttatcagcccctagttttacggggccttctagagggctctctcctgactccctaacacaattaattgaagatttttaaatgattccccaaatatatatcattatccactagaaaaatgttcacttgcttcaacatcctcttgcccaaaacttctcagtcagaaaactgttcttaatatcgaatttaaactccttcttcaatacatctattccttttattccaacctgaagcagaatttagtcatgaaattccacagattgctccctataactccactctcacatctttctcttttacataacccaaagatttggaaagacaagagtagacaataagcaaatgaatatatctgggagaacattatagtacttaagaaagaacactgcttcatgcccactcagcacctctcactcatgtgacctcacaactggattctcttacactattttctgagtgtgtgtgtgttctagtaattgtaagttcctgaaaggcagagccatgtcttctaattttcatagcactttggctcaagaagtcaataaagacatgtagccataagttggcacacttattaaaaccattcttattctttactttcaataaaaccagactcctaaggaccctagctctgattttcatacagactgacagatactaactctgaaatttgtaacaattaatttggtatttgaggcctgcccttcttcattcagtgccctctccctcaccccaagtggtctgcatttgggaggtgtgatggtccttaccaaggtctccctggacagtcaccatggagtctagagggtttaggttcatcttttactgtctctgtgtgatgggggaaggtggaaagaagatgatttcctcttaaatggtggaagggcctctcagatttcatgtggattataatatgattttgatagtcgggaaaaaaaaactctttacggactaagaagaaacaagatgatcctcataccctgaaaagtcctttccaaccttctctgtcaaacttctgttcttcccttggatgcaaatgcatgacagagcttgcagtgagctgcagaaagtgttgggaaaaacccagagatgaagagaatagagacttccaagagagcgtgtagtcaaacatccacccctgcctatcccagtgggtcccacaggtctctactggagtcatgaggtggtgtgtcccctactcattgctaagacccatgaacttggaggagacagtccaggggccatgatctggaaggggctgaagtgaagcagaataacaaacccacatccagttctagatcctgctacacaggagagccaaggcaagtcatggaaacaggttatgatcccaggagagagacagagagcagctgagtgagcaaaatagggggcagcctcaaatgatttctgaagcataagtctaaacctaatgccaaacagggctttttcatctgctcagagtcttagcatgagaattagcttcctttatttacaaagattggacagagacagggaaagggagacagaaaatataacaacagacacaggaactcaaaatc

SEQ ID NO: 362 - DNA, 21096 bp, Homo sapiens
ggggtgtagaggatggtgaccctcttctcacagctccactaggcagtgcccaagtggggactctgtgtgaggtctccaaccccacatttcccttccacactgccttagcagaagttctccatgagggcccagcccctgcagcacacctctgcctggacatccacgcatttccacacattctctgaaatctaggtggaggttcccaaacctcaattattgacttctgtgcacctgcagactcaacaccacatggaagctgccaaaacttggggcttgtaccccctgaagccatgacctgagctgtaccttggccccttttagccatggctggagcagctgggatgcagggcactaagtccctaggctgcacacaacagggcggccctggggccagcccctgaaaccatttttttcctcctaggcctctgggcctgagatgggaggggctgctgcaaaggtctctgacatgccccgaagacgttttccccattgtcttggtgattaacattgggcttctcattacttacgcaaatttctgtagcaggcttgaatttcttcccagaaaatgggtttttcttttttactgcattgtcaggctacaaatttcccaaacttttattttctgcttcctcttgaaccattttgccacttaaaaatttcttcttccagatacccttaatcatctctctcaaagttccacagaactctattgcagaggcaaaatgccaccagtctcttcgcatagcaagagtgacctttacttcagttcccaaaagttcctcatcttcatctgagaccacctcaacccggaccttattgttcatatcgctatcagcattttggtcaaagccattcaaccagtctctaggaagttccaaactctcccacatctttttgtcttctgagtactccaaacctctaggaagttccaaactttgtcacattttcctgtcttcttctgagccctccaaactgttccaacctctgcctgttacccatttccaaagttgcttccacattttcggtatctttacagcagtgccccacgacctggtaccaatttattatattagtctgttctcacgttgctaatagacatgcctgtgactgggtaatttataaggaaaaagaagtttaatggactcacagtttcaggtggctgaagaggcctcacagttatgatggaaggtgaaggaagaacaaaggcacatcttacatggtggcgggcaagagaagtgttgagcaaaagggggcaaagtcctttataaaaccatcagatctcgtgcgaactcactcactattacaagaacaacatgaaggtaaccacccccacgattcaattacctctacctggacctgcccttgacacatggggattattacaattcaaggtgagatttgggtggggacacggcctttccatgaatggagaacttaccatcaagaacttaccatgaatgaagcttgcaggactggaagttgctctgggtgagtcaatgtgtgagtggtgagtgaatgtgaaggcctaggatattaccgtacattacagtagactttatagacactgtatgcttaggttacattaagcttatttaaaaaattatcttttctcagtaatcaatcgaccttagcctactatgaatttttttattgatcattttttaaactttttgactcttttgtagtaacacttaggctaaaacacaaacacattgtacagctgtccaaaaatattttctttcttgatatccttactctataagtttttcttttataaaaatttttattgtttaattttttttattttttaaacttttttgttaagaactaagacacaagcacacgcattagcctaggtctacacagtgtcagggtcacaaatatcactgtcttccacctccacatcttgtcccactgcaaggtctttgggggcaattacaagcatggaactgccatctcctaggataactgcgctcttctggaatacctcttgaaagacctgcctgaggtctttttacaatgaatttcttttttttaaataagcagaagttacacttaactttctttttataagtagaagtatactttaagatactgataagaagtatagtaaatacatagaagtatagtaaatacatataccagtaacagttgtttgttattatcaaatattatgtgttataaaaaactgtgtgcactatagttttatacaactgataatgcagtaggcttgcttccaccagcatcatcacaaacaggtgagtgatgcattgtcctatgatgttaggatggctgcaatgtcactaggcaacaggaattttctgtttcattataatcttatgggaccactgttgtgtatgcaatctgtcatttacaaaaatgtcattatgtggcacatgacaataattatatttgtagttttaaatttttcatgagatgtaactagtttggacttttatttttattgatttgctctttcagtcttcatgtgactttctcagctaggaaaatttttttctactaatctttcatttttgcttctgtgccaaattgtctgtatgttggctgcccattctctgttcctttctgttattgcattacaatttttatgctatgttctttcccactgcattctagaaacatatttattataataataactagcattaattttgagcatttactaaatgaccttttcatattttgatgctgtcttcatgagaacccaaaaagtgagctctattaccatttctaatttatacacgaggaaactgaggccagattagactgagtaattttcccaggtttatgtgactaggaagtgacacagtcacgattttaacccaagcaggctggctttgaattgttgacttgtaatcaacattccactgcatactgtctgtcctacatatttacatagtccacaacacatgctatttgattttctggtgaatattttttgcctctttctgcctctactgtggatttcagttgtgcttttctagttgtactttccataaaagctttcttgtttgatccaattctacttttatatcataatgttctcttctgcagactttgtgctactcattcacaatgcctgctattcattcttaatcttaattaacttcttcttctgttgatgtcactaagtactttctgatagcatccccaccctgggctccttgattttttctgtatcttaaactttggttttctcaggggagtctttaactgtcttcttcctttcttgtctaacttacacactggggtttatttcattcactgctacggctttaagcacctatacatttgtgactcaaaagtaaatatttcaccccaagccgaatcctgagctacacagcagtatatttattcctgtaatgttggttgaacacctattttccaggtgcatgtgagacactagaaaattccacatgactgttatccagcaaccttaagcttttctccaaatctgcttttttattcttttgattacccatcttggtgaattctaatgttgctagttgtataaaccaaaatataaaattaatcccagaaaactctatttacttgccttttcattctgtcatctttattctacttctggaatatctcatttagtatttctcttcatttgaattatcactgtgtatttcttgggggaattgcagtagtctactttgttctcaacagtcataaaagtcatctttcaaatgtggcgctctaatgagcttactctttgtgtgatatatgttaattatctcccattccataaagtataattaataccaccacctttgcatggcacacacaacttttgtcatctggttttatcatttggtccctgcctacatatccagtcttttctcctttcacttcaaatcttttctaacttaagacactgtaattcagaaatactgaactatattcaaggtctcaaatatgatatgtcctttcactctttttgttcctttacacatttcctgaaatacactcatcattcagctatctacctgatgtttaactgttaatttattacttctttggaaatgccatgttctttatgaaattttctctgatttccacaggcagacgtgaatgctccatttactgctgatgatttgaatttgtatgtactggcctaatggcactaatcccattcaggaggactccacctttgtgatctaatcacttaccaaaggtttcacctcctagtaccatcatattggggtagtattttaacataagaattttgaaaggacagcaacagtgagccatgaacacaatgctgcacttcagtcgccagcctcctgggcaacagagtgagaccttgtctcaataaataaataaataaataaataaaataaaaaatagtgactagtcctataaaataaggagtcatgaaaataaggagttgtgcttcccagtcttcttgttttcttaacctctagtcatctaagcagcacacataaagttttgcattccatcccaacaaggagtctactgcaagaatgattcctgtagatgtgacagttgaaatgatgaaaatgattgatatctataaggtcaaagttagaaacttgaagggtcagctggaaattgcattcattttgttgcatttctaactactggcaacttaaccaattatttttgtctaagcaacaagatgtcccaagccagggctggtatggaagtttagttatgctatcaggaattagggatctttctatcttcatttctaccatacaaaacgtgttgatattcaccatcatcttgtggtcccatattgcaagatggccgttaagatttaagatagtgtgtctgcatttcagacagtgagaaacaaaaataaaaatggtaaatggtcaaatattatgccacaggtatctgctcttcctccactccccacccgaatgtaaagtggctctcaggagcaccatccagtagacttcaaccaacatctagctttctggaattacaccacattgtcacccccagcagcaaaagaatctgaaaataaatatttataaacaggaaatgttgccaccctgatcagtattgggtttctgcaaagaaaatggtaaaaattaatacggggtaagtagacagtggtacctgccccatcttgtaggtaataatttaaaaatgaatattcagtaaagcagacacaaaaaagatgtaaaaataatcaagagatttcagtgttacagaagtcagaagaaaaaaaactgtaagagggaagaaatatatagtaatatacaaaattttaaagaggttaaggacaaaaagtctaagaaaatattactaagtttgatgatcagagacaagctgcgacctccagggagagtaatttcaggacactcttttaaaagtgagcaattgttttagtaagagcaatgggtaactcaataggttaggaaagttagaaagtttatggaagacttttttttaggctaacggaaacttgagaattttttggctataggtagcagaattagtgaagattgaagatgtaaagaagggaacacaaaattgtaaaaacaaaatacgaaattttcatccagaggaaaaagaatcctttctttcattacctatattttaaagagatagttggacacagtgattctattccaatgagtctcaacttattttttttttaacatgctagttatagatcacttagtgcctgagcacattcagggataagaaactaattatccccagataactcaatcaatcgtttcaagttttaataactctaagaaatttattttaatattattctaaagtaattaaaattatttaagataaaaataaatttaaaattcaaaattatttaagataaataattatacaaattattttatactatcaacaaattatcctccttttaaaatcaattgctctttttgtatcttccagaactacacaaacaggattactgtttgttctatgtaactaggtagaactatcatgcttactcacattcttctctttccaagctgaacactcttaattcactcagtgattcttgaatgatattgttttccaacccactgattattctgattatgtttagtgttaagattgcacagtccattcaaatcatgaactcaagcacattctgaatagctatagttttctgagtctgaagttgattttagtctcttactggcaattgctttcatttatccaagccatgttacataacttatgctaatctttctcaaggccttattgttctttcatcttgtgattacatttctgtcattttagcctttgatttcctgatgattctgttggctcattctataggaaagggaccagaagtaattgatgtttggacagcttgaaccatgttgaatatggtaacagaaaagagaaccatagttctgagtggaatgttaattaatgaaagacaattattaatacgtataagtaatagttgaggaggatgaacaattgttttcaggaaccttactaaatttatggttttcctctgaggagcttgaccagccctttaaaccaactcagcaagtctgaatgatgtgcaaagggacaattagatatgggtaagaagtccccaacctcaacccataaaggactgtgtctgaggttcttacagcatcaagggagatggataccatggcttccatcaaggtgctgctagtcctgctctcaaaggctttggtgaccctgagctctgctcagagcatagatgatggcaagaggaggaaatggggacaatacaatggataacggggttaaaatgcatggaaagtactagagttagattgaccctttcagaaattaagcactttattttcagagagtaggtcaataaaagaggaggaaaccttaatttctatttttcactgattgcagatacttctctgaaaatctcggcctaagtcttaagtcaacgtcttcatgatgtaattttgccgttctaatgtatatggattttcagttgttgattctgtttgtgtgaatcagggcatctaaattgaacggaaaatctatatttttcatttctataatctataatagaattctataattctataattcatctagatatcgcatttccttgacatcaaactcttgaacatttaaaaatattgataattttgattaaatttgtacttaatcaaaattttgatgctaagcaggcactattaaattctttctattccattccttaatcctttaaaatacaggtcacccctcattcagagtcaatgattgggactagggttctactttgggaaactttggtttattgtatccaaatctttataattttttttccctaaagctctcttaggcatttttaaatctcttgtgtctaaacctaagtgtctttctagaaattcacagctggggttttatcaaatcatgttttaaatttgtcttctttttcatttttttttttctcttaaaatcctaagtactgttgctgaagagttctttcaagagtaaggtaaacctttattcagggatgtgttcttttctttgttcttcagaagctaccatagttttcttttttgtttaataaacattctcaaaattctcaaacattctcaaaattgagtttagggagtcccaaagggaaaaagagaattacaaaatctgaaagttttagtggttctcaataataacattgattgattgagacaagcctcctctgtcacccagattggagtgcagtggcatgaacacagctcactgcagcctccacctcctgggctcaagctatcctcctacctcaccctcctaagtagctgggactataggcacacaccatcacacccagctaattttaaaattttttatagagatggagtctcaccatgttgcccaggcttgtcttgaactcctgggctgaagatatcctcccacctcgtcctcctgaagtactgggactacaggcatgagccaccatacttggcccaataatgttaaatatggaccatctccttcattttcacattagaatctcttgtgtcagagttgtaattagcatttgaacatcagcagaatatagacacagtacttatttgtaaatgcttttctctaaatctttctacaaccaatggctaatgattgaataacacaaatctcccatttttgcaagagcaataactcccttgacatataactaatttgaagcataaagatacataaaatttgcctacattattgtagtcaatcagtgaatgtatcattgcactttcttttgccactctgaattaaaacacaaatgcttcattctttagttttcaagtcctgataactgcttaaacactaatttgtcacagagtaagtgaaatttaaagccaccattagtcacacacagtttacatgaaaaatttgaagtccattctaatggcctggggagagactctgtgtaggaggaaggatataatacatgcccagagtacatgagagagctaatgaattatgccaccaaagaagtggcagaattgagtaagtgagtcaaccaacaattttgttgttcaaagaaaacttttatgcttaatgatttttttcccctgtttctgacttgtcaatgacccttctactgagtttatgatgtcatttcaaacttcattctttttctcttctttctttgaaggaggctttcaagaggaagatgaaaagacctaactaccatgtgagctattttgagttcaattaagttattaagaattgttctaaatggattcaacgaacctctgggttactgttctaataaaacatttctacaagtttttactgtaatacaaataatcatgtttaaccatgaaaactttttttctctctttatttacaaatattttcttttttgtacacaaagttcctggctactctaggctggttagtacagggttgatcaccctaaaatatctttgccacaatatgaatgatgtgcttttgatggtatgtcccagatacatatttccttttgtggcctgacatatggcattgtctggagaatattcaatatatgcttgaaaagagaatgtgttgtctcttccttttatggaatctttcataaatatcagatcaggttgcttgatagtgtttgttaatgtattctatattcttacagatgttctgttgttcaacaaattactgaaatagaatcattgaaccctttaaaaaaagatgtcttatatacaatccaaacaatatttctctgggatgtagagatgatctacattgaggcaatatatcctttgagagttttgacattttagcataaccatgtattagcttttgattgaatgtcttgtcacagcatcttgataatcattgcctggtgcagtccgtggacatacgtcttttgtggagaaattttcttcaataaataattaatagttcaatttaggcttcttattttatagacattttctacataatttttctcacttttacttatagattgtccttcattcattgatctgcaattctcaaataatctttgaacttactgtgacaatatatttagccataatatataccttttctgtgattataagattattcatagaattccacagcatttattaagaactgtcactttattgagtctttcccaaaagtagagctttgttggatgatccaagaggaaccatctaacgcggactatgagaaggaactagttgcttttcataaagatgcaaataacagcaagatgctgttacagttgttttgaattagtcacacaactttgcatctggaaacacggtttagaactatgaaaatgccctctactcttgatagttgatattaggatattaatttctatttgctctgaaacatgttttaaaaaacagcaactctaaagaaaggaagagttacagaagagagaaacagggatacacagacagagtcagaaacagagacagagataaagagatccagccagctgtacataagattccctacattacaattacagatacactaattaagttttaggagtaattaatcacataaaacattaatgcaagaactgaagttaatttagaaacatcttatctttgtttgtcctagaaaagcatagtttctcttcagatttgtttatgttgttggaattttcttccttttagaatagacattactttccaaatcacctttagagatgcatgtcttaatttattgttccccagtattaggataaatgaatgacttgaggggtagattagagctatggactcaccaaaaatcacagctaattccgtctctggcataaagtagctggaggtggcaatgagaaaggacaaatagtaggcaataaagaggagaaggaaggaaatgacagctttcagggctctcacatgggcttctgtgctggggtctctgcaccctgtggcactgagctgcattcgcctgatatgtctccgcagggagaggatcaagaggaaaaaggacattaggcacacacaaaaggggagcagcgttgccaggttgagaaataacttggtagaagcatgttgagttttatttactctgcaactccaagttaagtttgttttcctctttgccttcacacaaaacctgaaatcagcgttcaaattctcagtggctggaaggctaataaacacagagagaaccacgcaccccagtagaatccaggaaatcaccctgtcaattctccacttcatccagaggaaaagtgggtgaaagaaattacctatcttgaagaaatagtaaatgctgaggcaggttgcaaaccagatacttaaatgattggttagtgtccagaagaagtcaatgattctcatttctttaccagtggcatagacatctggatatagcaccaatataaaacaatctaatagtattacgcacaatagacaaattctggatatggccagacttgtgaggattaaatcaatggaggcaattttcctcttcttgacccagtccatgcagtttaccaatccaatgaatgcattccctaagatccccactgaaaactctccaactgctaagaacaataaagtagtctgcactttatctgccatgtttaaatatgcaattagtttctagttgacctgatggagtttgacatccacacctgcttcttagattttgatgtagttttctttacctctttgttgtagtctgttttgtgatggagactggaatgataaatgaagactggagctatcttcattaaatcctaattagtcttgacaaacaatgtgtttggcgatccttggcctggccactgtatgcccatttacctactcagcaggttgtaattttccacatacggttaatttaggctgagctactgtttactaagatgcaaattgggccaattccctttcatggtcctgcattgtctttctgaggctaaggtgtacgcattttggattcattaatttgtgatgtatgctagtaacctcaatagggttgctagatttagcgactaaaaattcaggacactcagttaaacttgaattacaggtaaaaaaatcaataattttttagtgtatgtccctgattacttaagatcagtgctttcaggaagtactgaagttcaaattagattgagtgttccattctggcaacctgaacatcaagaatttggtagcaagtataaaactggtaaaattggaaagttcttgaagaatttttattttgctgaatgttaatattgataattagtaaagaatccaaagtttggttccatagtgagagttatatattttcaggaactttaaaaagttaacactaaatgtaggttatttgattccaaagaaactttaggtcattattttggctgttcagatgaacaattacatggcatagtgtctcttaatacaacacattgtcttactgactaaatgacttttaatggttatttagcaatgttatatataataaggtagaggacctgtaataaaaaaagactattgattaccttaaatttttcattttcacttaaaatgttctcaaggaaactttgagaggtattagatatgtccattaccttgtttgtggtgaagatatcatgggtgtttgaaattttatacattaaatatatgcggttctttttataccaattatactttcataaagatttcaaaaatttaaaaaatgttctcaagggtagttgtatgcatgagagaggagatagtaaaattctgtatttcattctctccactgtcctccatacaaattgcatgagtatctagatcctcaacccttctagcaggagactgaagattaaactttccacatctctagagatgaatttttagtttgaaatagcttctctaatttagagttactgagaagcgctttactacatggggttccatagaatagttcttgggtattcacaccttcctgggaatgcatgtcttctcttatccttccttaaaggacaaaccatcattccggagatgtagccttaacttttggacaatctgtatgattatgtagccatgttcacaggcaactggaacatcacctatgataggacgatcttggatatgatccctgacctagacttatcatttcttttgttttttttttgagatggaatttcgttcttgttgctcaggctggagtgctattttggctcaccgcaacctccatctcccaggttcaagtgattctcctgcctgagcctgccaagtagctgggattacaggcaggtgcaaccatgcctggctaattttgtatttttagtagattccgggtttctccatgttggtcaggctggtcttgaactcccgacctcaggcgatccgtgtgccttggcctcccaaagttctgggattacaggtgtgagccactgtgcctggcctagactcatcatttttaccctacagtttatcctggtaaatgaagtgctcatgggaactatgatgatgtattttctcaaataatttttagacttgtttttgtttagttttggaaataaatgtagattttatgaataccaatgttgtatagcgtgaagttatgtgaatatatagttaaaaaaaaagttctatgagagagcattttgtcaaaagcttactactttgaaccccagtcactgtggtcactagagatgcttgaaacattagagaggcaggaaacaaaatatggaagaaaaaaacttaaccctaatggggtaaaaccttcccaaaagtactaattcaataaaacgtttatttcacttaaaccttaggaaaaatataaagttcatcctagtataaaatctacctgtattttgtagaatacattaatatatttcatcaagagaacatgaattcttgtgtcttgtaaaacaaagagtaacatatacagctagcatattagaaatatagttcataaaatttatatacttggggctataaatattagtactttacagagtgagttttacataataataagacaaacaactgataattttccggtaattagtattttagttataataaaaggaaattagtagattgaaatacatcagaattaaacagaaagtaatgggagtaaaagcaataatgtacagccatattagtacatacacaacctgagatatgccagaccaaacgtttcaataatattatagtgaggatggatttcatgttcacagaaaaattaaaaattttagtgacttattttccttttttttttaataaaaatttatctgtattttttgtaaacattcgtttcttcttccagggacagtatgtgcttattccatggtatacgctattttcttcccaatttatttcttttgttaagtcctgagtgaaaacctttgcagggtctggttagagaaaagaacctgattgagcagtctgactaatatttgttatccccattcttttatccagattgtgaagagggcttaggaacaccccttggtgggtggcacttgaatgggttcgattcccacctaggtgctgcatgaaaagcaagttgtttgagaggaaatttaattccaaggaaaatcaatagaaatcatcagaataaggtcaaccagaaaatattacctaggagaccatggaaatcatcattcgggaaaaccaaagacagaccagagaacatctgagttcctaatcaataagccaaatgggggtgactcagcagagccatgaaaggagcacaattaaggagcggcaataaaaatgtatgacaaagaaaaatgagaaaccagttactgtagctcaggtccactttaccatgagccaaagtaaaatctaaaaagactttaactaggcaatacaggcctaacacttgcgttgaggagacaagaagagaagcatgagctctgaaattcttcgaggaaagggagtgtaaagatgagcatttctgagttgtaaagggatagaaaagatgtattcagtagtttgctactaggtcctaataatatttaaagatatgcatccaaaataaatgagataactggggaaaaatgagaatagactattaagaaaactatattttttgttagagaagatttggttttaaattccatttatacagctaagatttcatatcatgcaggcaatttttctacatgtcagcattctgacaaatgtctgcctcagtttattatttaaaacaattaaaataagtgagtgacccaaggggtagagaattgctgcaatctctccaaactccacagctaacttgtattttgtcataagatagctaaaggtcatcaaaatagaagaaatatagtataggaaaaaaaagaagataaatgaagtcatagttttaatggctctcacatgaacttctgtgctggggtctctactgccggtagcatagagttttatttgcttggtatgtctccataaagatcttactaaaaggaaaaatgatatcagtgacacaataaatgggacaattgcaaacaggttaaagagagtcaagggttcaaagtatggtattttactcacatggaacatttcagtaatgtttcttttatgtttggcaattgcatgaaacctataatcacaactcagtactattgctgctataaggctgaccaacaaggaaatggcaaagcatcccagcaggatccagtgcaccaccatatcaattttccacttcagccagagaaaaagtggatgagaggaactggctatcttcagaaaatagaagacattaaggcaggtggtaatccacatatttaagtagttggcaaatgtccagaaggtaaaaatgactatctgttgtttattttttgtataaacatctgggttcagtactattacaatgccatttacaaccattacactgatcaaacaaattctggcgataactaaattggtaaggatgtagtcaactgtggaaatctttttcttcttaatccagtcaatccagttgactagtgcaatgtatccattccccaatattcctagtatgaattctccagttattaggattataaagatgttatctgcaggactgaacatgtttgtagagagaacaatctgatttcaaatatcactgtagatgagctaatttacaggtgacctgttaaagcatgatagatcaattcttcgaatcatgcaataatgttttcatctgctgttatttcgacgttgttattcttccggaagtgttcagctctcctctgaaataggattgtctctacactcctgaagatgaaaccaactaatgagcagcttgactagttatttatagcctggaaaaattataattattatcctttagtgagtgatacctgaaatgtttggctgaaattgctcccatgcaaattcaaagagattttatatcatgaatttgcaacaggcttcttgctgtagctctatatttggatcttcaaattgagttttgaatagggagtcataaaaaaagagataaatgtttaataaaaacccaactgtgtaaataaaacttcattttcatcatgtaagttataaataagccacaaatcagttctcccagatgcaaagaaattttcactttggaagtaattagtacaattagattgtagatatttaacatttagtcagaggataataattcttgtcttcatttaaacggctaattagggaaggatataatacaaatctaattagaaatgacttttttttaggcaggcacatgataatatttactaagaatttgctttcttttcaattgttcctcagaagtgaaatatgccaggtaaagatttgttatctttagtttttttttaatgtgacaaatacccttgaagacaattcatttcctgaatcactgtctcttgtataataagcattgtaatctaaaattaagaaaatttaaattttacattattctagttccaatcaactccttttataagatttgtaatctcacagtgcatattatagtcatatttctagatagggcaaacacataaaaaagtaactacttgggagactgaggcagggggatcatttgaaccgggaggcagaggttgcagtgagccaagatcgtgccactgcactccaacctgggcgatacagtgagactctgtctcaaaataataataataattttttttttttacataccagtatttccaaggaataggactaattctactattaaattagatttatttgttttggggtaagggaaagtacaacttagcccaaaatacatttgaatgtaggtaatacaaatcacaataccctagggcttcttgtatttaaatagttctacaatgtatacaacacatgcaggattttttctatttcttacatgtgtgtaatgtgtaacaggaaagcataaacttaataacttaaagaaacctagttatctataaactactgctggaaacaaaatagaaaagaaaatgatgcagagggaaaaaaatatgtcagagatttctgagttagaaggctagagagaacattccagggaatctttgggaaatgacttctaaaattgccatcaccagctagagtactcatgaacacgctgactactgggaccctcaaccttctttctcaaggtggttctgctatacataactgtgcctcctctctctgtcaaactttcattcttgagattatactccttttcccacatcatatatcatcttagatagaatctcattaaagattgtttttctcccttcttgatcaagacaaacccttccagaaatggagaggaaagggcggtgaagataaggaccggccttcatttcaaagtagagagttgttttgcatgattgattttatagcaagggttgatgagttctaaaatcttttccccaaagcctgtttgcctgacattcttctactcattgagttcaaggcctttgccagtatttgtcagaaaagaagtagaacctctttgtatttagtcaatgacataaaatgatgaaatgttagtgtgggatttagatgcattttttttttctgcaacgacaaagaatatacggtgcaatgataacattagattatccattaaacaagacaaaagtgtgaaggaacacaaaacaaatcttcagaatcatgacagatattaatgacttccaatagcatataagagaaaatgaatgcaaacaagagaagggagaatgccttttgttgatttctttcatccttgtagtcaggatactctttaggggtctctatggaacaaaaggctttcttcttctaaggaaacacttcacaaatcttaacatcttcagaaaagcttccctcaacttgctatttcccataattagaatgaatgaatggcttgatgggaaaatgacagttactatgtcaccaatcatcaacactaattttccctgaggaatcagagcgctagaggtcataacaagaaagactgggtagtacacgatgaggaggagcagaaagatgatcactgcctttatggccctcatgtgggcctctgtactggggtctctgaaccctgtagcatgcagtcgaatctgcttggtgtgtctaactagggagaaaagtaacaagaaaaatgagatcaggcaaaggataaagggaaccatcacccccaggttcagggttaactgtttgaaagtacctggaattttactcactttgaatttccaagtaatgttttcttcatgactgactttgaaaaggtgataccacatatcatcattctttggaacactaataattaaagagataagaaaggaccccagaagaatcgcaagcatgaccttgttgatctttagcttcagccagaagaaaaatgggtgcgatatattggctatcttgagtaaatagaagatactgaggcaagaagtaaaccagagacttgaattattggcaaatgtccagacaacattcacaatgcttactagcacgctattgccatatgtacctggaaagagcagcataaagaagccatctaatgatattacacacagcagacagattctggagatggccaagctgatcaggatgatgtcaatcaaggaaatatctcttcttttgagccagtcaatgcagttaactagtacaatgaatccatttccccaaatccctatggtcaattcaccagcaattaaaataatatatattgcctctattgcacttggcatgccagcaaagacttgtgatttttgaatatcactgatgatgaattgactttcagctgaccagtgaagaacaatgtatctgtctgcctcttagaccatgatatagttgtctttatctctcctttttgttagctgtgatgcagatgaagaagatagccagtcctgctctgggctagagctgcctaaagacttcaatgattggggccagtaatttcctttggtgcagtgatgactgaaagcctctaggatgcaaatgggaatggatctgatttcttaaatttgcacactctttcttattttaagctctgtatattttggatttatcaatctgagctgttgaccaggaacttcaagaaggtatcaattacttggaaaatatggctagaatttaatttgctggatgactatccatccttgttagtatattgacatagttattgctattacagattctaggtttactgtgttagcttgtgtggccagtttgcttgcttggttgactaaagctttaaacaaattattattaacattaaatgaggcttaaatggcataactggtggaatgtagaggaaagaatctaaaggtgtaggaagataggagtattaaggtgaatttatcatatgcgaacttcaccttctccccattatatgacttaagagggccaaaaggacactccattcactagggcattgagaaatacattaattaggtaattcccaatatcctcaaaaagctctgcagtgtttgtcttctcaactgaagatacaatgagggaaataaacatgacattgtagtgttgtcagcaaatgagacacggaaaattctggtttagatgttagggtttcttagagtgttcttgctttgtacctgaatgtagcttccatacatagaaaaaatagtcaaaatactggtcacttatctttagaatggaaacagatcagcctgaacagtgaggaggacaaagagcaagaaagtgatatttttggaactaaaaagcgtgatagatatacaagactcttcagtctgaactgagtgataagaatacatgctctgaattttcttagctctattttttggcagcaggtgtattataaatattagtatgctaattatacacacattggaaacacactgtttcattgggacatattgaaacatgtcattgggcatagtagaacatatttgaaataatagaaaaaggcacacagcaatacacagttcccagaaatattattttgaaactaatattaaattttaaggcaatattaaatattgcttatcaaacaaacacaacaatacaaagtatttaatgagataatgtgtcatatgttcagggttttagacaaaataaagagataaaaattaatcttgcagatttttatgagaaagtaaatagctattgttattctattcagtgaaatttggggtttctttcatgcttctctgtgaattttgtttctgaagaaatatcagattatacaactcaaaaatacacactgtgcttgtcatgaccaaagccataaaacaggtaatattctgagaaggacttcactagagtaaagaaattgatttgcatgcaactgacagacaaggtcgcaccatgttcacatctcagggaatgcaatatttcattattttaattaaactttttgaaagataaaattttgtggaggggaataaagtaggttcaaggttattatttggaaatggaactactctgggatcaatttgtaatgtccagaaaagatgaagatgaaaatatatcatgtaggagggtgattaataactgacatattaaaaattcctggtaaatccagatatagaatccaagcttgccttctgaatcatggtctttcccactacctcacttcttttccttagccgtgtggaatactgatcaatttaagaaagttatgcctatattcaaatgtaaacgaaaatatgctataggatatgaccagagttacctaagggcctatacttactaaaatgccaccctcttttatctttccttgctataaataaaacccaaatgatctcaatttatttgacaccgttgaatatgttttttttgtgtgtattgtgtgtgtgtgtgagtttatgtgttatttgccctttggattttatcttagcattgagaagttaaagagggatcctagctgacagactttaacatctattttcattgcagaaacactttaatctagaatgttagtttattgattatttctgtctctactagaaaacagatgaaatactgggaaacttatgacatcatttcctgtatgtctttctatgagaagtgagcaaacacaaacctacttaggcagatatttcttaaatttcattttctttcctttgtttaaatactttttaccattctttagaaccttacatcttttacaggcatttgtccttgagttatgccactgattattactgatcaagagaaatgactatactcttcagatttataaatcaagaacaggatactgcgatactgtcctattttctgacaacttatattttgaatagttgctgactttatctcctac

SEQ ID NO: 363 - DNA, 20930 bp, Homo sapiens
tcctgtagatgtgacagttgaaatgatgaaaatgattgatatctataaggtcaaagttagaaacttgaagggtcagctggaaattgcattcattttgttgcatttctaactactggcaacttaaccaattatttttgtctaagcaacaagatgtcccaagccagggctggtatggaagtttagttatgctatcaggaattagggatctttctatcttcatttctaccatacaaaacgtgttgatattcaccatcatcttgtggtcccatattgcaagatggccgttaagatttaagatagtgtgtctgcatttcagacagtgagaaacaaaaataaaaatggtaaatggtcaaatattatgccacaggtatctgctcttcctccactccccacccgaatgtaaagtggctctcaggagcaccatccagtagacttcaaccaacatctagctttctggaattacaccacattgtcacccccagcagcaaaagaatctgaaaataaatatttataaacaggaaatgttgccaccctgatcagtattgggtttctgcaaagaaaatggtaaaaattaatacggggtaagtagacagtggtacctgccccatcttgtaggtaataatttaaaaatgaatattcagtaaagcagacacaaaaaagatgtaaaaataatcaagagatttcagtgttacagaagtcagaagaaaaaaaactgtaagagggaagaaatatatagtaatatacaaaattttaaagaggttaaggacaaaaagtctaagaaaatattactaagtttgatgatcagagacaagctgcgacctccagggagagtaatttcaggacactcttttaaaagtgagcaattgttttagtaagagcaatgggtaactcaataggttaggaaagttagaaagtttatggaagacttttttttaggctaacggaaacttgagaattttttggctataggtagcagaattagtgaagattgaagatgtaaagaagggaacacaaaattgtaaaaacaaaatacgaaattttcatccagaggaaaaagaatcctttctttcattacctatattttaaagagatagttggacacagtgattctattccaatgagtctcaacttattttttttttaacatgctagttatagatcacttagtgcctgagcacattcagggataagaaactaattatccccagataactcaatcaatcgtttcaagttttaataactctaagaaatttattttaatattattctaaagtaattaaaattatttaagataaaaataaatttaaaattcaaaattatttaagataaataattatacaaattattttatactatcaacaaattatcctccttttaaaatcaattgctctttttgtatcttccagaactacacaaacaggattactgtttgttctatgtaactaggtagaactatcatgcttactcacattcttctctttccaagctgaacactcttaattcactcagtgattcttgaatgatattgttttccaacccactgattattctgattatgtttagtgttaagattgcacagtccattcaaatcatgaactcaagcacattctgaatagctatagttttctgagtctgaagttgattttagtctcttactggcaattgctttcatttatccaagccatgttacataacttatgctaatctttctcaaggccttattgttctttcatcttgtgattacatttctgtcattttagcctttgatttcctgatgattctgttggctcattctataggaaagggaccagaagtaattgatgtttggacagcttgaaccatgttgaatatggtaacagaaaagagaaccatagttctgagtggaatgttaattaatgaaagacaattattaatacgtataagtaatagttgaggaggatgaacaattgttttcaggaaccttactaaatttatggttttcctctgaggagcttgaccagccctttaaaccaactcagcaagtctgaatgatgtgcaaagggacaattagatatgggtaagaagtccccaacctcaacccataaaggactgtgtctgaggttcttacagcatcaagggagatggataccatggcttccatcaaggtgctgctagtcctgctctcaaaggctttggtgaccctgagctctgctcagagcatagatgatggcaagaggaggaaatggggacaatacaatggataacggggttaaaatgcatggaaagtactagagttagattgaccctttcagaaattaagcactttattttcagagagtaggtcaataaaagaggaggaaaccttaatttctatttttcactgattgcagatacttctctgaaaatctcggcctaagtcttaagtcaacgtcttcatgatgtaattttgccgttctaatgtatatggattttcagttgttgattctgtttgtgtgaatcagggcatctaaattgaacggaaaatctatatttttcatttctataatctataatagaattctataattctataattcatctagatatcgcatttccttgacatcaaactcttgaacatttaaaaatattgataattttgattaaatttgtacttaatcaaaattttgatgctaagcaggcactattaaattctttctattccattccttaatcctttaaaatacaggtcacccctcattcagagtcaatgattgggactagggttctactttgggaaactttggtttattgtatccaaatctttataattttttttccctaaagctctcttaggcatttttaaatctcttgtgtctaaacctaagtgtctttctagaaattcacagctggggttttatcaaatcatgttttaaatttgtcttctttttcatttttttttttctcttaaaatcctaagtactgttgctgaagagttctttcaagagtaaggtaaacctttattcagggatgtgttcttttctttgttcttcagaagctaccatagttttcttttttgtttaataaacattctcaaaattctcaaacattctcaaaattgagtttagggagtcccaaagggaaaaagagaattacaaaatctgaaagttttagtggttctcaataataacattgattgattgagacaagcctcctctgtcacccagattggagtgcagtggcatgaacacagctcactgcagcctccacctcctgggctcaagctatcctcctacctcaccctcctaagtagctgggactataggcacacaccatcacacccagctaattttaaaattttttatagagatggagtctcaccatgttgcccaggcttgtcttgaactcctgggctgaagatatcctcccacctcgtcctcctgaagtactgggactacaggcatgagccaccatacttggcccaataatgttaaatatggaccatctccttcattttcacattagaatctcttgtgtcagagttgtaattagcatttgaacatcagcagaatatagacacagtacttatttgtaaatgcttttctctaaatctttctacaaccaatggctaatgattgaataacacaaatctcccatttttgcaagagcaataactcccttgacatataactaatttgaagcataaagatacataaaatttgcctacattattgtagtcaatcagtgaatgtatcattgcactttcttttgccactctgaattaaaacacaaatgcttcattctttagttttcaagtcctgataactgcttaaacactaatttgtcacagagtaagtgaaatttaaagccaccattagtcacacacagtttacatgaaaaatttgaagtccattctaatggcctggggagagactctgtgtaggaggaaggatataatacatgcccagagtacatgagagagctaatgaattatgccaccaaagaagtggcagaattgagtaagtgagtcaaccaacaattttgttgttcaaagaaaacttttatgcttaatgatttttttcccctgtttctgacttgtcaatgacccttctactgagtttatgatgtcatttcaaacttcattctttttctcttctttctttgaaggaggctttcaagaggaagatgaaaagacctaactaccatgtgagctattttgagttcaattaagttattaagaattgttctaaatggattcaacgaacctctgggttactgttctaataaaacatttctacaagtttttactgtaatacaaataatcatgtttaaccatgaaaactttttttctctctttatttacaaatattttcttttttgtacacaaagttcctggctactctaggctggttagtacagggttgatcaccctaaaatatctttgccacaatatgaatgatgtgcttttgatggtatgtcccagatacatatttccttttgtggcctgacatatggcattgtctggagaatattcaatatatgcttgaaaagagaatgtgttgtctcttccttttatggaatctttcataaatatcagatcaggttgcttgatagtgtttgttaatgtattctatattcttacagatgttctgttgttcaacaaattactgaaatagaatcattgaaccctttaaaaaaagatgtcttatatacaatccaaacaatatttctctgggatgtagagatgatctacattgaggcaatatatcctttgagagttttgacattttagcataaccatgtattagcttttgattgaatgtcttgtcacagcatcttgataatcattgcctggtgcagtccgtggacatacgtcttttgtggagaaattttcttcaataaataattaatagttcaatttaggcttcttattttatagacattttctacataatttttctcacttttacttatagattgtccttcattcattgatctgcaattctcaaataatctttgaacttactgtgacaatatatttagccataatatataccttttctgtgattataagattattcatagaattccacagcatttattaagaactgtcactttattgagtctttcccaaaagtagagctttgttggatgatccaagaggaaccatctaacgcggactatgagaaggaactagttgcttttcataaagatgcaaataacagcaagatgctgttacagttgttttgaattagtcacacaactttgcatctggaaacacggtttagaactatgaaaatgccctctactcttgatagttgatattaggatattaatttctatttgctctgaaacatgttttaaaaaacagcaactctaaagaaaggaagagttacagaagagagaaacagggatacacagacagagtcagaaacagagacagagataaagagatccagccagctgtacataagattccctacattacaattacagatacactaattaagttttaggagtaattaatcacataaaacattaatgcaagaactgaagttaatttagaaacatcttatctttgtttgtcctagaaaagcatagtttctcttcagatttgtttatgttgttggaattttcttccttttagaatagacattactttccaaatcacctttagagatgcatgtcttaatttattgttccccagtattaggataaatgaatgacttgaggggtagattagagctatggactcaccaaaaatcacagctaattccgtctctggcataaagtagctggaggtggcaatgagaaaggacaaatagtaggcaataaagaggagaaggaaggaaatgacagctttcagggctctcacatgggcttctgtgctggggtctctgcaccctgtggcactgagctgcattcgcctgatatgtctccgcagggagaggatcaagaggaaaaaggacattaggcacacacaaaaggggagcagcgttgccaggttgagaaataacttggtagaagcatgttgagttttatttactctgcaactccaagttaagtttgttttcctctttgccttcacacaaaacctgaaatcagcgttcaaattctcagtggctggaaggctaataaacacagagagaaccacgcaccccagtagaatccaggaaatcaccctgtcaattctccacttcatccagaggaaaagtgggtgaaagaaattacctatcttgaagaaatagtaaatgctgaggcaggttgcaaaccagatacttaaatgattggttagtgtccagaagaagtcaatgattctcatttctttaccagtggcatagacatctggatatagcaccaatataaaacaatctaatagtattacgcacaatagacaaattctggatatggccagacttgtgaggattaaatcaatggaggcaattttcctcttcttgacccagtccatgcagtttaccaatccaatgaatgcattccctaagatccccactgaaaactctccaactgctaagaacaataaagtagtctgcactttatctgccatgtttaaatatgcaattagtttctagttgacctgatggagtttgacatccacacctgcttcttagattttgatgtagttttctttacctctttgttgtagtctgttttgtgatggagactggaatgataaatgaagactggagctatcttcattaaatcctaattagtcttgacaaacaatgtgtttggcgatccttggcctggccactgtatgcccatttacctactcagcaggttgtaattttccacatacggttaatttaggctgagctactgtttactaagatgcaaattgggccaattccctttcatggtcctgcattgtctttctgaggctaaggtgtacgcattttggattcattaatttgtgatgtatgctagtaacctcaatagggttgctagatttagcgactaaaaattcaggacactcagttaaacttgaattacaggtaaaaaaatcaataattttttagtgtatgtccctgattacttaagatcagtgctttcaggaagtactgaagttcaaattagattgagtgttccattctggcaacctgaacatcaagaatttggtagcaagtataaaactggtaaaattggaaagttcttgaagaatttttattttgctgaatgttaatattgataattagtaaagaatccaaagtttggttccatagtgagagttatatattttcaggaactttaaaaagttaacactaaatgtaggttatttgattccaaagaaactttaggtcattattttggctgttcagatgaacaattacatggcatagtgtctcttaatacaacacattgtcttactgactaaatgacttttaatggttatttagcaatgttatatataataaggtagaggacctgtaataaaaaaagactattgattaccttaaatttttcattttcacttaaaatgttctcaaggaaactttgagaggtattagatatgtccattaccttgtttgtggtgaagatatcatgggtgtttgaaattttatacattaaatatatgcggttctttttataccaattatactttcataaagatttcaaaaatttaaaaaatgttctcaagggtagttgtatgcatgagagaggagatagtaaaattctgtatttcattctctccactgtcctccatacaaattgcatgagtatctagatcctcaacccttctagcaggagactgaagattaaactttccacatctctagagatgaatttttagtttgaaatagcttctctaatttagagttactgagaagcgctttactacatggggttccatagaatagttcttgggtattcacaccttcctgggaatgcatgtcttctcttatccttccttaaaggacaaaccatcattccggagatgtagccttaacttttggacaatctgtatgattatgtagccatgttcacaggcaactggaacatcacctatgataggacgatcttggatatgatccctgacctagacttatcatttcttttgttttttttttgagatggaatttcgttcttgttgctcaggctggagtgctattttggctcaccgcaacctccatctcccaggttcaagtgattctcctgcctgagcctgccaagtagctgggattacaggcaggtgcaaccatgcctggctaattttgtatttttagtagattccgggtttctccatgttggtcaggctggtcttgaactcccgacctcaggcgatccgtgtgccttggcctcccaaagttctgggattacaggtgtgagccactgtgcctggcctagactcatcatttttaccctacagtttatcctggtaaatgaagtgctcatgggaactatgatgatgtattttctcaaataatttttagacttgtttttgtttagttttggaaataaatgtagattttatgaataccaatgttgtatagcgtgaagttatgtgaatatatagttaaaaaaaaagttctatgagagagcattttgtcaaaagcttactactttgaaccccagtcactgtggtcactagagatgcttgaaacattagagaggcaggaaacaaaatatggaagaaaaaaacttaaccctaatggggtaaaaccttcccaaaagtactaattcaataaaacgtttatttcacttaaaccttaggaaaaatataaagttcatcctagtataaaatctacctgtattttgtagaatacattaatatatttcatcaagagaacatgaattcttgtgtcttgtaaaacaaagagtaacatatacagctagcatattagaaatatagttcataaaatttatatacttggggctataaatattagtactttacagagtgagttttacataataataagacaaacaactgataattttccggtaattagtattttagttataataaaaggaaattagtagattgaaatacatcagaattaaacagaaagtaatgggagtaaaagcaataatgtacagccatattagtacatacacaacctgagatatgccagaccaaacgtttcaataatattatagtgaggatggatttcatgttcacagaaaaattaaaaattttagtgacttattttccttttttttttaataaaaatttatctgtattttttgtaaacattcgtttcttcttccagggacagtatgtgcttattccatggtatacgctattttcttcccaatttatttcttttgttaagtcctgagtgaaaacctttgcagggtctggttagagaaaagaacctgattgagcagtctgactaatatttgttatccccattcttttatccagattgtgaagagggcttaggaacaccccttggtgggtggcacttgaatgggttcgattcccacctaggtgctgcatgaaaagcaagttgtttgagaggaaatttaattccaaggaaaatcaatagaaatcatcagaataaggtcaaccagaaaatattacctaggagaccatggaaatcatcattcgggaaaaccaaagacagaccagagaacatctgagttcctaatcaataagccaaatgggggtgactcagcagagccatgaaaggagcacaattaaggagcggcaataaaaatgtatgacaaagaaaaatgagaaaccagttactgtagctcaggtccactttaccatgagccaaagtaaaatctaaaaagactttaactaggcaatacaggcctaacacttgcgttgaggagacaagaagagaagcatgagctctgaaattcttcgaggaaagggagtgtaaagatgagcatttctgagttgtaaagggatagaaaagatgtattcagtagtttgctactaggtcctaataatatttaaagatatgcatccaaaataaatgagataactggggaaaaatgagaatagactattaagaaaactatattttttgttagagaagatttggttttaaattccatttatacagctaagatttcatatcatgcaggcaatttttctacatgtcagcattctgacaaatgtctgcctcagtttattatttaaaacaattaaaataagtgagtgacccaaggggtagagaattgctgcaatctctccaaactccacagctaacttgtattttgtcataagatagctaaaggtcatcaaaatagaagaaatatagtataggaaaaaaaagaagataaatgaagtcatagttttaatggctctcacatgaacttctgtgctggggtctctactgccggtagcatagagttttatttgcttggtatgtctccataaagatcttactaaaaggaaaaatgatatcagtgacacaataaatgggacaattgcaaacaggttaaagagagtcaagggttcaaagtatggtattttactcacatggaacatttcagtaatgtttcttttatgtttggcaattgcatgaaacctataatcacaactcagtactattgctgctataaggctgaccaacaaggaaatggcaaagcatcccagcaggatccagtgcaccaccatatcaattttccacttcagccagagaaaaagtggatgagaggaactggctatcttcagaaaatagaagacattaaggcaggtggtaatccacatatttaagtagttggcaaatgtccagaaggtaaaaatgactatctgttgtttattttttgtataaacatctgggttcagtactattacaatgccatttacaaccattacactgatcaaacaaattctggcgataactaaattggtaaggatgtagtcaactgtggaaatctttttcttcttaatccagtcaatccagttgactagtgcaatgtatccattccccaatattcctagtatgaattctccagttattaggattataaagatgttatctgcaggactgaacatgtttgtagagagaacaatctgatttcaaatatcactgtagatgagctaatttacaggtgacctgttaaagcatgatagatcaattcttcgaatcatgcaataatgttttcatctgctgttatttcgacgttgttattcttccggaagtgttcagctctcctctgaaataggattgtctctacactcctgaagatgaaaccaactaatgagcagcttgactagttatttatagcctggaaaaattataattattatcctttagtgagtgatacctgaaatgtttggctgaaattgctcccatgcaaattcaaagagattttatatcatgaatttgcaacaggcttcttgctgtagctctatatttggatcttcaaattgagttttgaatagggagtcataaaaaaagagataaatgtttaataaaaacccaactgtgtaaataaaacttcattttcatcatgtaagttataaataagccacaaatcagttctcccagatgcaaagaaattttcactttggaagtaattagtacaattagattgtagatatttaacatttagtcagaggataataattcttgtcttcatttaaacggctaattagggaaggatataatacaaatctaattagaaatgacttttttttaggcaggcacatgataatatttactaagaatttgctttcttttcaattgttcctcagaagtgaaatatgccaggtaaagatttgttatctttagtttttttttaatgtgacaaatacccttgaagacaattcatttcctgaatcactgtctcttgtataataagcattgtaatctaaaattaagaaaatttaaattttacattattctagttccaatcaactccttttataagatttgtaatctcacagtgcatattatagtcatatttctagatagggcaaacacataaaaaagtaactacttgggagactgaggcagggggatcatttgaaccgggaggcagaggttgcagtgagccaagatcgtgccactgcactccaacctgggcgatacagtgagactctgtctcaaaataataataataattttttttttttacataccagtatttccaaggaataggactaattctactattaaattagatttatttgttttggggtaagggaaagtacaacttagcccaaaatacatttgaatgtaggtaatacaaatcacaataccctagggcttcttgtatttaaatagttctacaatgtatacaacacatgcaggattttttctatttcttacatgtgtgtaatgtgtaacaggaaagcataaacttaataacttaaagaaacctagttatctataaactactgctggaaacaaaatagaaaagaaaatgatgcagagggaaaaaaatatgtcagagatttctgagttagaaggctagagagaacattccagggaatctttgggaaatgacttctaaaattgccatcaccagctagagtactcatgaacacgctgactactgggaccctcaaccttctttctcaaggtggttctgctatacataactgtgcctcctctctctgtcaaactttcattcttgagattatactccttttcccacatcatatatcatcttagatagaatctcattaaagattgtttttctcccttcttgatcaagacaaacccttccagaaatggagaggaaagggcggtgaagataaggaccggccttcatttcaaagtagagagttgttttgcatgattgattttatagcaagggttgatgagttctaaaatcttttccccaaagcctgtttgcctgacattcttctactcattgagttcaaggcctttgccagtatttgtcagaaaagaagtagaacctctttgtatttagtcaatgacataaaatgatgaaatgttagtgtgggatttagatgcattttttttttctgcaacgacaaagaatatacggtgcaatgataacattagattatccattaaacaagacaaaagtgtgaaggaacacaaaacaaatcttcagaatcatgacagatattaatgacttccaatagcatataagagaaaatgaatgcaaacaagagaagggagaatgccttttgttgatttctttcatccttgtagtcaggatactctttaggggtctctatggaacaaaaggctttcttcttctaaggaaacacttcacaaatcttaacatcttcagaaaagcttccctcaacttgctatttcccataattagaatgaatgaatggcttgatgggaaaatgacagttactatgtcaccaatcatcaacactaattttccctgaggaatcagagcgctagaggtcataacaagaaagactgggtagtacacgatgaggaggagcagaaagatgatcactgcctttatggccctcatgtgggcctctgtactggggtctctgaaccctgtagcatgcagtcgaatctgcttggtgtgtctaactagggagaaaagtaacaagaaaaatgagatcaggcaaaggataaagggaaccatcacccccaggttcagggttaactgtttgaaagtacctggaattttactcactttgaatttccaagtaatgttttcttcatgactgactttgaaaaggtgataccacatatcatcattctttggaacactaataattaaagagataagaaaggaccccagaagaatcgcaagcatgaccttgttgatctttagcttcagccagaagaaaaatgggtgcgatatattggctatcttgagtaaatagaagatactgaggcaagaagtaaaccagagacttgaattattggcaaatgtccagacaacattcacaatgcttactagcacgctattgccatatgtacctggaaagagcagcataaagaagccatctaatgatattacacacagcagacagattctggagatggccaagctgatcaggatgatgtcaatcaaggaaatatctcttcttttgagccagtcaatgcagttaactagtacaatgaatccatttccccaaatccctatggtcaattcaccagcaattaaaataatatatattgcctctattgcacttggcatgccagcaaagacttgtgatttttgaatatcactgatgatgaattgactttcagctgaccagtgaagaacaatgtatctgtctgcctcttagaccatgatatagttgtctttatctctcctttttgttagctgtgatgcagatgaagaagatagccagtcctgctctgggctagagctgcctaaagacttcaatgattggggccagtaatttcctttggtgcagtgatgactgaaagcctctaggatgcaaatgggaatggatctgatttcttaaatttgcacactctttcttattttaagctctgtatattttggatttatcaatctgagctgttgaccaggaacttcaagaaggtatcaattacttggaaaatatggctagaatttaatttgctggatgactatccatccttgttagtatattgacatagttattgctattacagattctaggtttactgtgttagcttgtgtggccagtttgcttgcttggttgactaaagctttaaacaaattattattaacattaaatgaggcttaaatggcataactggtggaatgtagaggaaagaatctaaaggtgtaggaagataggagtattaaggtgaatttatcatatgcgaacttcaccttctccccattatatgacttaagagggccaaaaggacactccattcactagggcattgagaaatacattaattaggtaattcccaatatcctcaaaaagctctgcagtgtttgtcttctcaactgaagatacaatgagggaaataaacatgacattgtagtgttgtcagcaaatgagacacggaaaattctggtttagatgttagggtttcttagagtgttcttgctttgtacctgaatgtagcttccatacatagaaaaaatagtcaaaatactggtcacttatctttagaatggaaacagatcagcctgaacagtgaggaggacaaagagcaagaaagtgatatttttggaactaaaaagcgtgatagatatacaagactcttcagtctgaactgagtgataagaatacatgctctgaattttcttagctctattttttggcagcaggtgtattataaatattagtatgctaattatacacacattggaaacacactgtttcattgggacatattgaaacatgtcattgggcatagtagaacatatttgaaataatagaaaaaggcacacagcaatacacagttcccagaaatattattttgaaactaatattaaattttaaggcaatattaaatattgcttatcaaacaaacacaacaatacaaagtatttaatgagataatgtgtcatatgttcagggttttagacaaaataaagagataaaaattaatcttgcagatttttatgagaaagtaaatagctattgttattctattcagtgaaatttggggtttctttcatgcttctctgtgaattttgtttctgaagaaatatcagattatacaactcaaaaatacacactgtgcttgtcatgaccaaagccataaaacaggtaatattctgagaaggacttcactagagtaaagaaattgatttgcatgcaactgacagacaaggtcgcaccatgttcacatctcagggaatgcaatatttcattattttaattaaactttttgaaagataaaattttgtggaggggaataaagtaggttcaaggttattatttggaaatggaactactctgggatcaatttgtaatgtccagaaaagatgaagatgaaaatatatcatgtaggagggtgattaataactgacatattaaaaattcctggtaaatccagatatagaatccaagcttgccttctgaatcatggtctttcccactacctcacttcttttccttagccgtgtggaatactgatcaatttaagaaagttatgcctatattcaaatgtaaacgaaaatatgctataggatatgaccagagttacctaagggcctatacttactaaaatgccaccctcttttatctttccttgctataaataaaacccaaatgatctcaatttatttgacaccgttgaatatgttttttttgtgtgtattgtgtgtgtgtgtgagtttatgtgttatttgccctttggattttatcttagcattgagaagttaaagagggatcctagctgacagactttaacatctattttcattgcagaaacactttaatctagaatgttagtttattgattatttctgtctctactagaaaacagatgaaatactgggaaacttatgacatcatttcctgtatgtctttctatgagaagtgagcaaacacaaacctacttaggcagatatttcttaaatttcattttctttcctttgtttaaatactttttaccattctttagaaccttacatcttttacaggcatttgtccttgagttatgccactgattattactgatcaagagaaatgactatactcttcagatttataaatcaagaacaggatactgcgatactgtcctattttctgacaacttatattttgaatagttgctgactttatctcctaccccattctaaactcttcactatatccattgggatccctagtaaaccattagcagaagccatatattctcatttgtttctctaacagttcactttattttcttcatttgaactcgaggttctggaacttttttgttcaatggactactttgccagtctggtgcatgctataatttcagaataatgtttttaagtgcatgaaataaaaatatttgaaatgtataaggaatccatatatatatgcctttttcttgcagtatgaaatatattgttaatataatataggaatttatgtgctttttaattgacataacaaaaatatctggcagataaagactagtggtgaaagtaaatgacaataggaggtacctgtaacgacaaaaatttttggcttcctgaagtgaaaaaattacagatactgctggtatggtatgtgcttgttacttacattcaagacagaagaaatactagacttaagctaaggattaataaaaataagtatataatttggtgcccctcccagttcattcatcactcatgtccatgaatcttttcattttaatactctacaattaaatcctgtggcagctgttttctctctcacaccctcatagaagtgggtctaaagctgggatgggtgtttttctttccctctcgtaactttcagattactctactctctttcctttttccttttttttttttttttttttgagacaaagtttcactgtgttgcttaggctgttcttgaactcctggcctctagtgatcctcctgccttggcctcccaaaatgttaagattacaagtgtgagtcactgtgcctggccagattattctccgtctaattcctcacaagacatacagcagttcattatctcctgtcatcactctatacaaaatattacctttccttgtcacaatcataagccagtcttccttccttgatttttgctttctacctgaaattaagtagttaaatatactaaatttcaccaccattctttttgctaaagttcccctatctttttgttggatgaaataatcttctattttttaaaaaaattcattcagtaatcttgtttgttgtatttttctttttttaaaatttaattatggacatataatagttgtacagatgtatgggggtacatgtgaacctcatgaaaacagagcaatataaagacccctgttgagaagggataacatgaatgagaaatatgcatgtctctttaagaagaggaacagtcttaattaatggataactatatagagtcaataattcaagcataaaacactttattataatagcatattgggaatagtcttgtctatttgtataaaaatggtgaagaaatagaatatttgggatccatggagacaaataatttatttgctaaataacaaaatttggacaaggcttgaaatatatataacagttaagagcttcagctctggtgccagacagctggagttgaagcttattctcagttttaatgattgtgtgatttaaattgtgctgaatcttttctttctccaatgtgtaaaacattgatcatagtgctatctatctcatagaaatattatacttaaataaagtcttgcatttaaaatacttagaatagttcttaccatatatactcaaaaaattttaggtactattattattgaattttttggcattccattcaataaatcacgattctcttatctagttgttttgctatagagcctttattaatgtgtcttaattacaatttcctatccataatatttggccaaatttcacattttatgattgccatagtttgaatgtttgtattttcttcaaaattcatgtggaaatgtaatccctaatgcaacaatattaagaggtggggccttttaggagatgattatgatgggtttgccattatgatgggattaaaaggcctgaagggaactaaataggtcttttaacctttcccctcttctgccatgaaaagatacagcattcaaggttccatgttggaagcagtgacgaagccctcaccagacaccaaacctgccactgccttagtcttggactttctagccttcagcactatgaaaaaataaatttctgttatttataaactacctcatctcagatactttttatagcagcaaaatggactaagacaatgccagtcacatgaaatcataaaatatggcaacataatagttatggtttaacaatttgttttgttttccattactcactgaaaatgtaaacaaacttaaatggacttagttgtttttttccttcatatgtagttcttttctttattcaatattaatgcccagtgcatctcataatattaatggacaggtgactattttgtttctctctgcaatggcataaataaaatgattttaacagcatttcaacttaaacacaataaattatttatttatatttgacaacacatctaaatgttcaggttaagtaaaaatattctcagatatataggtttcagacgtttactaaacatagaacttttttcaacattttggaggctacattaacaaaaactataatggggtgaggagatacctatatgaatatgtggagtaaagtttataagaaattttgtaaggcttaggatgtcaaaaaattttttaaaaataagaaaagaacatttgtatactataaaaatcttaaaactccagttgtaggtagaagatcaacacataaaactgtgttgtgtttctacacaccagcaatctgaacagtgaatataaaaggtaaattaagaaaacaattccaaaataatgaaataactaggaataaatttcaccaaagaagcaaaatacttatatacaaaaattgatgaaacattgctgaaagacattaaggaagacacaagtaagtagaaagacatcccatgttcatggataagatgacttgatactgttaagatatcaatactacccaaagcaatctaaagattcattaaaattcctatcaaaaatttctacagacttcgtttcagaaagaggaaaactaatgctcaaattcaggtgaaattacaagggaatccgaatacccaaaacaatctttaaaaaggagaacaaagttggaaaactcacatttaatatttttattttatatatatatatatacatatatatatatacatatatatatatatacacatatatatatatatatatatatatatatatttttttttttttttccctgtatgcctcattaagtcttccctgagccctgggctggcttcttccatggaagatagcagaagaagcaaggcttgtccctgttcacagaagatgctagccagatcaggagctgaagatagcaaaagagggagaagtccaacccacagtcccaggccctggtgagtaaggtctggtgcgaggagaaggctgatgatatggaagggtgctccagtcctgcttcttctgcttggaaatggagaatccggagaacctgggggatgcaagatggacaggctgctccttgagaacatccagtctcctagaaaaaatgggtgctctcaaggtgactgaatgaactcaactatgccttgttattttaaaacccactgtctgctttctgaattgacaatcaagaatccatgtgtgtcttaaacaacaattgttcattgtagtagaacccactgggagaagccttttggctcaggaactccatctagccacagctgattgaattaggggtggatacctaacccaagtggagccaatcttattctgtgcccactgcaatgtaagatgtaaaataggtatttttgtctccttggatcagtgctgtatctttagtgtctagaattctgcctaccacacagtaggggctacatgaatatttaatgaacaaatgaatgaataaataagtctctgtgaggaatttggaattttgaccttggaaacacagagaatggcagttgtggaaactgagtcacattggctgcataagctagaaagaacacccactccttcccatgtctgaggtcttcgggtctatctcagtcatgactgagtcctgactctttctaaagatgattggactcctcttaactttaggacagatggctcaacatcctaactataaaactccttcctcctttcctgcttacattcatttctgttgcaaccaaaaacctttaatgacatgctgagaaattttgcaccttgacatattctgttccccaccttaggagcttctctaggagtcataatcactcctggctgtaccttgggctgcatccagatctgccccaatgccaccacccccagctctgtgggctctggctctaagactacagggacccagaagcaggaaagagtggcatc

SEQ ID NO: 364 - DNA, 21075 bp, Homo sapiens
cattctcaaaattctcaaacattctcaaaattgagtttagggagtcccaaagggaaaaagagaattacaaaatctgaaagttttagtggttctcaataataacattgattgattgagacaagcctcctctgtcacccagattggagtgcagtggcatgaacacagctcactgcagcctccacctcctgggctcaagctatcctcctacctcaccctcctaagtagctgggactataggcacacaccatcacacccagctaattttaaaattttttatagagatggagtctcaccatgttgcccaggcttgtcttgaactcctgggctgaagatatcctcccacctcgtcctcctgaagtactgggactacaggcatgagccaccatacttggcccaataatgttaaatatggaccatctccttcattttcacattagaatctcttgtgtcagagttgtaattagcatttgaacatcagcagaatatagacacagtacttatttgtaaatgcttttctctaaatctttctacaaccaatggctaatgattgaataacacaaatctcccatttttgcaagagcaataactcccttgacatataactaatttgaagcataaagatacataaaatttgcctacattattgtagtcaatcagtgaatgtatcattgcactttcttttgccactctgaattaaaacacaaatgcttcattctttagttttcaagtcctgataactgcttaaacactaatttgtcacagagtaagtgaaatttaaagccaccattagtcacacacagtttacatgaaaaatttgaagtccattctaatggcctggggagagactctgtgtaggaggaaggatataatacatgcccagagtacatgagagagctaatgaattatgccaccaaagaagtggcagaattgagtaagtgagtcaaccaacaattttgttgttcaaagaaaacttttatgcttaatgatttttttcccctgtttctgacttgtcaatgacccttctactgagtttatgatgtcatttcaaacttcattctttttctcttctttctttgaaggaggctttcaagaggaagatgaaaagacctaactaccatgtgagctattttgagttcaattaagttattaagaattgttctaaatggattcaacgaacctctgggttactgttctaataaaacatttctacaagtttttactgtaatacaaataatcatgtttaaccatgaaaactttttttctctctttatttacaaatattttcttttttgtacacaaagttcctggctactctaggctggttagtacagggttgatcaccctaaaatatctttgccacaatatgaatgatgtgcttttgatggtatgtcccagatacatatttccttttgtggcctgacatatggcattgtctggagaatattcaatatatgcttgaaaagagaatgtgttgtctcttccttttatggaatctttcataaatatcagatcaggttgcttgatagtgtttgttaatgtattctatattcttacagatgttctgttgttcaacaaattactgaaatagaatcattgaaccctttaaaaaaagatgtcttatatacaatccaaacaatatttctctgggatgtagagatgatctacattgaggcaatatatcctttgagagttttgacattttagcataaccatgtattagcttttgattgaatgtcttgtcacagcatcttgataatcattgcctggtgcagtccgtggacatacgtcttttgtggagaaattttcttcaataaataattaatagttcaatttaggcttcttattttatagacattttctacataatttttctcacttttacttatagattgtccttcattcattgatctgcaattctcaaataatctttgaacttactgtgacaatatatttagccataatatataccttttctgtgattataagattattcatagaattccacagcatttattaagaactgtcactttattgagtctttcccaaaagtagagctttgttggatgatccaagaggaaccatctaacgcggactatgagaaggaactagttgcttttcataaagatgcaaataacagcaagatgctgttacagttgttttgaattagtcacacaactttgcatctggaaacacggtttagaactatgaaaatgccctctactcttgatagttgatattaggatattaatttctatttgctctgaaacatgttttaaaaaacagcaactctaaagaaaggaagagttacagaagagagaaacagggatacacagacagagtcagaaacagagacagagataaagagatccagccagctgtacataagattccctacattacaattacagatacactaattaagttttaggagtaattaatcacataaaacattaatgcaagaactgaagttaatttagaaacatcttatctttgtttgtcctagaaaagcatagtttctcttcagatttgtttatgttgttggaattttcttccttttagaatagacattactttccaaatcacctttagagatgcatgtcttaatttattgttccccagtattaggataaatgaatgacttgaggggtagattagagctatggactcaccaaaaatcacagctaattccgtctctggcataaagtagctggaggtggcaatgagaaaggacaaatagtaggcaataaagaggagaaggaaggaaatgacagctttcagggctctcacatgggcttctgtgctggggtctctgcaccctgtggcactgagctgcattcgcctgatatgtctccgcagggagaggatcaagaggaaaaaggacattaggcacacacaaaaggggagcagcgttgccaggttgagaaataacttggtagaagcatgttgagttttatttactctgcaactccaagttaagtttgttttcctctttgccttcacacaaaacctgaaatcagcgttcaaattctcagtggctggaaggctaataaacacagagagaaccacgcaccccagtagaatccaggaaatcaccctgtcaattctccacttcatccagaggaaaagtgggtgaaagaaattacctatcttgaagaaatagtaaatgctgaggcaggttgcaaaccagatacttaaatgattggttagtgtccagaagaagtcaatgattctcatttctttaccagtggcatagacatctggatatagcaccaatataaaacaatctaatagtattacgcacaatagacaaattctggatatggccagacttgtgaggattaaatcaatggaggcaattttcctcttcttgacccagtccatgcagtttaccaatccaatgaatgcattccctaagatccccactgaaaactctccaactgctaagaacaataaagtagtctgcactttatctgccatgtttaaatatgcaattagtttctagttgacctgatggagtttgacatccacacctgcttcttagattttgatgtagttttctttacctctttgttgtagtctgttttgtgatggagactggaatgataaatgaagactggagctatcttcattaaatcctaattagtcttgacaaacaatgtgtttggcgatccttggcctggccactgtatgcccatttacctactcagcaggttgtaattttccacatacggttaatttaggctgagctactgtttactaagatgcaaattgggccaattccctttcatggtcctgcattgtctttctgaggctaaggtgtacgcattttggattcattaatttgtgatgtatgctagtaacctcaatagggttgctagatttagcgactaaaaattcaggacactcagttaaacttgaattacaggtaaaaaaatcaataattttttagtgtatgtccctgattacttaagatcagtgctttcaggaagtactgaagttcaaattagattgagtgttccattctggcaacctgaacatcaagaatttggtagcaagtataaaactggtaaaattggaaagttcttgaagaatttttattttgctgaatgttaatattgataattagtaaagaatccaaagtttggttccatagtgagagttatatattttcaggaactttaaaaagttaacactaaatgtaggttatttgattccaaagaaactttaggtcattattttggctgttcagatgaacaattacatggcatagtgtctcttaatacaacacattgtcttactgactaaatgacttttaatggttatttagcaatgttatatataataaggtagaggacctgtaataaaaaaagactattgattaccttaaatttttcattttcacttaaaatgttctcaaggaaactttgagaggtattagatatgtccattaccttgtttgtggtgaagatatcatgggtgtttgaaattttatacattaaatatatgcggttctttttataccaattatactttcataaagatttcaaaaatttaaaaaatgttctcaagggtagttgtatgcatgagagaggagatagtaaaattctgtatttcattctctccactgtcctccatacaaattgcatgagtatctagatcctcaacccttctagcaggagactgaagattaaactttccacatctctagagatgaatttttagtttgaaatagcttctctaatttagagttactgagaagcgctttactacatggggttccatagaatagttcttgggtattcacaccttcctgggaatgcatgtcttctcttatccttccttaaaggacaaaccatcattccggagatgtagccttaacttttggacaatctgtatgattatgtagccatgttcacaggcaactggaacatcacctatgataggacgatcttggatatgatccctgacctagacttatcatttcttttgttttttttttgagatggaatttcgttcttgttgctcaggctggagtgctattttggctcaccgcaacctccatctcccaggttcaagtgattctcctgcctgagcctgccaagtagctgggattacaggcaggtgcaaccatgcctggctaattttgtatttttagtagattccgggtttctccatgttggtcaggctggtcttgaactcccgacctcaggcgatccgtgtgccttggcctcccaaagttctgggattacaggtgtgagccactgtgcctggcctagactcatcatttttaccctacagtttatcctggtaaatgaagtgctcatgggaactatgatgatgtattttctcaaataatttttagacttgtttttgtttagttttggaaataaatgtagattttatgaataccaatgttgtatagcgtgaagttatgtgaatatatagttaaaaaaaaagttctatgagagagcattttgtcaaaagcttactactttgaaccccagtcactgtggtcactagagatgcttgaaacattagagaggcaggaaacaaaatatggaagaaaaaaacttaaccctaatggggtaaaaccttcccaaaagtactaattcaataaaacgtttatttcacttaaaccttaggaaaaatataaagttcatcctagtataaaatctacctgtattttgtagaatacattaatatatttcatcaagagaacatgaattcttgtgtcttgtaaaacaaagagtaacatatacagctagcatattagaaatatagttcataaaatttatatacttggggctataaatattagtactttacagagtgagttttacataataataagacaaacaactgataattttccggtaattagtattttagttataataaaaggaaattagtagattgaaatacatcagaattaaacagaaagtaatgggagtaaaagcaataatgtacagccatattagtacatacacaacctgagatatgccagaccaaacgtttcaataatattatagtgaggatggatttcatgttcacagaaaaattaaaaattttagtgacttattttccttttttttttaataaaaatttatctgtattttttgtaaacattcgtttcttcttccagggacagtatgtgcttattccatggtatacgctattttcttcccaatttatttcttttgttaagtcctgagtgaaaacctttgcagggtctggttagagaaaagaacctgattgagcagtctgactaatatttgttatccccattcttttatccagattgtgaagagggcttaggaacaccccttggtgggtggcacttgaatgggttcgattcccacctaggtgctgcatgaaaagcaagttgtttgagaggaaatttaattccaaggaaaatcaatagaaatcatcagaataaggtcaaccagaaaatattacctaggagaccatggaaatcatcattcgggaaaaccaaagacagaccagagaacatctgagttcctaatcaataagccaaatgggggtgactcagcagagccatgaaaggagcacaattaaggagcggcaataaaaatgtatgacaaagaaaaatgagaaaccagttactgtagctcaggtccactttaccatgagccaaagtaaaatctaaaaagactttaactaggcaatacaggcctaacacttgcgttgaggagacaagaagagaagcatgagctctgaaattcttcgaggaaagggagtgtaaagatgagcatttctgagttgtaaagggatagaaaagatgtattcagtagtttgctactaggtcctaataatatttaaagatatgcatccaaaataaatgagataactggggaaaaatgagaatagactattaagaaaactatattttttgttagagaagatttggttttaaattccatttatacagctaagatttcatatcatgcaggcaatttttctacatgtcagcattctgacaaatgtctgcctcagtttattatttaaaacaattaaaataagtgagtgacccaaggggtagagaattgctgcaatctctccaaactccacagctaacttgtattttgtcataagatagctaaaggtcatcaaaatagaagaaatatagtataggaaaaaaaagaagataaatgaagtcatagttttaatggctctcacatgaacttctgtgctggggtctctactgccggtagcatagagttttatttgcttggtatgtctccataaagatcttactaaaaggaaaaatgatatcagtgacacaataaatgggacaattgcaaacaggttaaagagagtcaagggttcaaagtatggtattttactcacatggaacatttcagtaatgtttcttttatgtttggcaattgcatgaaacctataatcacaactcagtactattgctgctataaggctgaccaacaaggaaatggcaaagcatcccagcaggatccagtgcaccaccatatcaattttccacttcagccagagaaaaagtggatgagaggaactggctatcttcagaaaatagaagacattaaggcaggtggtaatccacatatttaagtagttggcaaatgtccagaaggtaaaaatgactatctgttgtttattttttgtataaacatctgggttcagtactattacaatgccatttacaaccattacactgatcaaacaaattctggcgataactaaattggtaaggatgtagtcaactgtggaaatctttttcttcttaatccagtcaatccagttgactagtgcaatgtatccattccccaatattcctagtatgaattctccagttattaggattataaagatgttatctgcaggactgaacatgtttgtagagagaacaatctgatttcaaatatcactgtagatgagctaatttacaggtgacctgttaaagcatgatagatcaattcttcgaatcatgcaataatgttttcatctgctgttatttcgacgttgttattcttccggaagtgttcagctctcctctgaaataggattgtctctacactcctgaagatgaaaccaactaatgagcagcttgactagttatttatagcctggaaaaattataattattatcctttagtgagtgatacctgaaatgtttggctgaaattgctcccatgcaaattcaaagagattttatatcatgaatttgcaacaggcttcttgctgtagctctatatttggatcttcaaattgagttttgaatagggagtcataaaaaaagagataaatgtttaataaaaacccaactgtgtaaataaaacttcattttcatcatgtaagttataaataagccacaaatcagttctcccagatgcaaagaaattttcactttggaagtaattagtacaattagattgtagatatttaacatttagtcagaggataataattcttgtcttcatttaaacggctaattagggaaggatataatacaaatctaattagaaatgacttttttttaggcaggcacatgataatatttactaagaatttgctttcttttcaattgttcctcagaagtgaaatatgccaggtaaagatttgttatctttagtttttttttaatgtgacaaatacccttgaagacaattcatttcctgaatcactgtctcttgtataataagcattgtaatctaaaattaagaaaatttaaattttacattattctagttccaatcaactccttttataagatttgtaatctcacagtgcatattatagtcatatttctagatagggcaaacacataaaaaagtaactacttgggagactgaggcagggggatcatttgaaccgggaggcagaggttgcagtgagccaagatcgtgccactgcactccaacctgggcgatacagtgagactctgtctcaaaataataataataattttttttttttacataccagtatttccaaggaataggactaattctactattaaattagatttatttgttttggggtaagggaaagtacaacttagcccaaaatacatttgaatgtaggtaatacaaatcacaataccctagggcttcttgtatttaaatagttctacaatgtatacaacacatgcaggattttttctatttcttacatgtgtgtaatgtgtaacaggaaagcataaacttaataacttaaagaaacctagttatctataaactactgctggaaacaaaatagaaaagaaaatgatgcagagggaaaaaaatatgtcagagatttctgagttagaaggctagagagaacattccagggaatctttgggaaatgacttctaaaattgccatcaccagctagagtactcatgaacacgctgactactgggaccctcaaccttctttctcaaggtggttctgctatacataactgtgcctcctctctctgtcaaactttcattcttgagattatactccttttcccacatcatatatcatcttagatagaatctcattaaagattgtttttctcccttcttgatcaagacaaacccttccagaaatggagaggaaagggcggtgaagataaggaccggccttcatttcaaagtagagagttgttttgcatgattgattttatagcaagggttgatgagttctaaaatcttttccccaaagcctgtttgcctgacattcttctactcattgagttcaaggcctttgccagtatttgtcagaaaagaagtagaacctctttgtatttagtcaatgacataaaatgatgaaatgttagtgtgggatttagatgcattttttttttctgcaacgacaaagaatatacggtgcaatgataacattagattatccattaaacaagacaaaagtgtgaaggaacacaaaacaaatcttcagaatcatgacagatattaatgacttccaatagcatataagagaaaatgaatgcaaacaagagaagggagaatgccttttgttgatttctttcatccttgtagtcaggatactctttaggggtctctatggaacaaaaggctttcttcttctaaggaaacacttcacaaatcttaacatcttcagaaaagcttccctcaacttgctatttcccataattagaatgaatgaatggcttgatgggaaaatgacagttactatgtcaccaatcatcaacactaattttccctgaggaatcagagcgctagaggtcataacaagaaagactgggtagtacacgatgaggaggagcagaaagatgatcactgcctttatggccctcatgtgggcctctgtactggggtctctgaaccctgtagcatgcagtcgaatctgcttggtgtgtctaactagggagaaaagtaacaagaaaaatgagatcaggcaaaggataaagggaaccatcacccccaggttcagggttaactgtttgaaagtacctggaattttactcactttgaatttccaagtaatgttttcttcatgactgactttgaaaaggtgataccacatatcatcattctttggaacactaataattaaagagataagaaaggaccccagaagaatcgcaagcatgaccttgttgatctttagcttcagccagaagaaaaatgggtgcgatatattggctatcttgagtaaatagaagatactgaggcaagaagtaaaccagagacttgaattattggcaaatgtccagacaacattcacaatgcttactagcacgctattgccatatgtacctggaaagagcagcataaagaagccatctaatgatattacacacagcagacagattctggagatggccaagctgatcaggatgatgtcaatcaaggaaatatctcttcttttgagccagtcaatgcagttaactagtacaatgaatccatttccccaaatccctatggtcaattcaccagcaattaaaataatatatattgcctctattgcacttggcatgccagcaaagacttgtgatttttgaatatcactgatgatgaattgactttcagctgaccagtgaagaacaatgtatctgtctgcctcttagaccatgatatagttgtctttatctctcctttttgttagctgtgatgcagatgaagaagatagccagtcctgctctgggctagagctgcctaaagacttcaatgattggggccagtaatttcctttggtgcagtgatgactgaaagcctctaggatgcaaatgggaatggatctgatttcttaaatttgcacactctttcttattttaagctctgtatattttggatttatcaatctgagctgttgaccaggaacttcaagaaggtatcaattacttggaaaatatggctagaatttaatttgctggatgactatccatccttgttagtatattgacatagttattgctattacagattctaggtttactgtgttagcttgtgtggccagtttgcttgcttggttgactaaagctttaaacaaattattattaacattaaatgaggcttaaatggcataactggtggaatgtagaggaaagaatctaaaggtgtaggaagataggagtattaaggtgaatttatcatatgcgaacttcaccttctccccattatatgacttaagagggccaaaaggacactccattcactagggcattgagaaatacattaattaggtaattcccaatatcctcaaaaagctctgcagtgtttgtcttctcaactgaagatacaatgagggaaataaacatgacattgtagtgttgtcagcaaatgagacacggaaaattctggtttagatgttagggtttcttagagtgttcttgctttgtacctgaatgtagcttccatacatagaaaaaatagtcaaaatactggtcacttatctttagaatggaaacagatcagcctgaacagtgaggaggacaaagagcaagaaagtgatatttttggaactaaaaagcgtgatagatatacaagactcttcagtctgaactgagtgataagaatacatgctctgaattttcttagctctattttttggcagcaggtgtattataaatattagtatgctaattatacacacattggaaacacactgtttcattgggacatattgaaacatgtcattgggcatagtagaacatatttgaaataatagaaaaaggcacacagcaatacacagttcccagaaatattattttgaaactaatattaaattttaaggcaatattaaatattgcttatcaaacaaacacaacaatacaaagtatttaatgagataatgtgtcatatgttcagggttttagacaaaataaagagataaaaattaatcttgcagatttttatgagaaagtaaatagctattgttattctattcagtgaaatttggggtttctttcatgcttctctgtgaattttgtttctgaagaaatatcagattatacaactcaaaaatacacactgtgcttgtcatgaccaaagccataaaacaggtaatattctgagaaggacttcactagagtaaagaaattgatttgcatgcaactgacagacaaggtcgcaccatgttcacatctcagggaatgcaatatttcattattttaattaaactttttgaaagataaaattttgtggaggggaataaagtaggttcaaggttattatttggaaatggaactactctgggatcaatttgtaatgtccagaaaagatgaagatgaaaatatatcatgtaggagggtgattaataactgacatattaaaaattcctggtaaatccagatatagaatccaagcttgccttctgaatcatggtctttcccactacctcacttcttttccttagccgtgtggaatactgatcaatttaagaaagttatgcctatattcaaatgtaaacgaaaatatgctataggatatgaccagagttacctaagggcctatacttactaaaatgccaccctcttttatctttccttgctataaataaaacccaaatgatctcaatttatttgacaccgttgaatatgttttttttgtgtgtattgtgtgtgtgtgtgagtttatgtgttatttgccctttggattttatcttagcattgagaagttaaagagggatcctagctgacagactttaacatctattttcattgcagaaacactttaatctagaatgttagtttattgattatttctgtctctactagaaaacagatgaaatactgggaaacttatgacatcatttcctgtatgtctttctatgagaagtgagcaaacacaaacctacttaggcagatatttcttaaatttcattttctttcctttgtttaaatactttttaccattctttagaaccttacatcttttacaggcatttgtccttgagttatgccactgattattactgatcaagagaaatgactatactcttcagatttataaatcaagaacaggatactgcgatactgtcctattttctgacaacttatattttgaatagttgctgactttatctcctaccccattctaaactcttcactatatccattgggatccctagtaaaccattagcagaagccatatattctcatttgtttctctaacagttcactttattttcttcatttgaactcgaggttctggaacttttttgttcaatggactactttgccagtctggtgcatgctataatttcagaataatgtttttaagtgcatgaaataaaaatatttgaaatgtataaggaatccatatatatatgcctttttcttgcagtatgaaatatattgttaatataatataggaatttatgtgctttttaattgacataacaaaaatatctggcagataaagactagtggtgaaagtaaatgacaataggaggtacctgtaacgacaaaaatttttggcttcctgaagtgaaaaaattacagatactgctggtatggtatgtgcttgttacttacattcaagacagaagaaatactagacttaagctaaggattaataaaaataagtatataatttggtgcccctcccagttcattcatcactcatgtccatgaatcttttcattttaatactctacaattaaatcctgtggcagctgttttctctctcacaccctcatagaagtgggtctaaagctgggatgggtgtttttctttccctctcgtaactttcagattactctactctctttcctttttccttttttttttttttttttttgagacaaagtttcactgtgttgcttaggctgttcttgaactcctggcctctagtgatcctcctgccttggcctcccaaaatgttaagattacaagtgtgagtcactgtgcctggccagattattctccgtctaattcctcacaagacatacagcagttcattatctcctgtcatcactctatacaaaatattacctttccttgtcacaatcataagccagtcttccttccttgatttttgctttctacctgaaattaagtagttaaatatactaaatttcaccaccattctttttgctaaagttcccctatctttttgttggatgaaataatcttctattttttaaaaaaattcattcagtaatcttgtttgttgtatttttctttttttaaaatttaattatggacatataatagttgtacagatgtatgggggtacatgtgaacctcatgaaaacagagcaatataaagacccctgttgagaagggataacatgaatgagaaatatgcatgtctctttaagaagaggaacagtcttaattaatggataactatatagagtcaataattcaagcataaaacactttattataatagcatattgggaatagtcttgtctatttgtataaaaatggtgaagaaatagaatatttgggatccatggagacaaataatttatttgctaaataacaaaatttggacaaggcttgaaatatatataacagttaagagcttcagctctggtgccagacagctggagttgaagcttattctcagttttaatgattgtgtgatttaaattgtgctgaatcttttctttctccaatgtgtaaaacattgatcatagtgctatctatctcatagaaatattatacttaaataaagtcttgcatttaaaatacttagaatagttcttaccatatatactcaaaaaattttaggtactattattattgaattttttggcattccattcaataaatcacgattctcttatctagttgttttgctatagagcctttattaatgtgtcttaattacaatttcctatccataatatttggccaaatttcacattttatgattgccatagtttgaatgtttgtattttcttcaaaattcatgtggaaatgtaatccctaatgcaacaatattaagaggtggggccttttaggagatgattatgatgggtttgccattatgatgggattaaaaggcctgaagggaactaaataggtcttttaacctttcccctcttctgccatgaaaagatacagcattcaaggttccatgttggaagcagtgacgaagccctcaccagacaccaaacctgccactgccttagtcttggactttctagccttcagcactatgaaaaaataaatttctgttatttataaactacctcatctcagatactttttatagcagcaaaatggactaagacaatgccagtcacatgaaatcataaaatatggcaacataatagttatggtttaacaatttgttttgttttccattactcactgaaaatgtaaacaaacttaaatggacttagttgtttttttccttcatatgtagttcttttctttattcaatattaatgcccagtgcatctcataatattaatggacaggtgactattttgtttctctctgcaatggcataaataaaatgattttaacagcatttcaacttaaacacaataaattatttatttatatttgacaacacatctaaatgttcaggttaagtaaaaatattctcagatatataggtttcagacgtttactaaacatagaacttttttcaacattttggaggctacattaacaaaaactataatggggtgaggagatacctatatgaatatgtggagtaaagtttataagaaattttgtaaggcttaggatgtcaaaaaattttttaaaaataagaaaagaacatttgtatactataaaaatcttaaaactccagttgtaggtagaagatcaacacataaaactgtgttgtgtttctacacaccagcaatctgaacagtgaatataaaaggtaaattaagaaaacaattccaaaataatgaaataactaggaataaatttcaccaaagaagcaaaatacttatatacaaaaattgatgaaacattgctgaaagacattaaggaagacacaagtaagtagaaagacatcccatgttcatggataagatgacttgatactgttaagatatcaatactacccaaagcaatctaaagattcattaaaattcctatcaaaaatttctacagacttcgtttcagaaagaggaaaactaatgctcaaattcaggtgaaattacaagggaatccgaatacccaaaacaatctttaaaaaggagaacaaagttggaaaactcacatttaatatttttattttatatatatatatatacatatatatatatacatatatatatatatacacatatatatatatatatatatatatatatatttttttttttttttccctgtatgcctcattaagtcttccctgagccctgggctggcttcttccatggaagatagcagaagaagcaaggcttgtccctgttcacagaagatgctagccagatcaggagctgaagatagcaaaagagggagaagtccaacccacagtcccaggccctggtgagtaaggtctggtgcgaggagaaggctgatgatatggaagggtgctccagtcctgcttcttctgcttggaaatggagaatccggagaacctgggggatgcaagatggacaggctgctccttgagaacatccagtctcctagaaaaaatgggtgctctcaaggtgactgaatgaactcaactatgccttgttattttaaaacccactgtctgctttctgaattgacaatcaagaatccatgtgtgtcttaaacaacaattgttcattgtagtagaacccactgggagaagccttttggctcaggaactccatctagccacagctgattgaattaggggtggatacctaacccaagtggagccaatcttattctgtgcccactgcaatgtaagatgtaaaataggtatttttgtctccttggatcagtgctgtatctttagtgtctagaattctgcctaccacacagtaggggctacatgaatatttaatgaacaaatgaatgaataaataagtctctgtgaggaatttggaattttgaccttggaaacacagagaatggcagttgtggaaactgagtcacattggctgcataagctagaaagaacacccactccttcccatgtctgaggtcttcgggtctatctcagtcatgactgagtcctgactctttctaaagatgattggactcctcttaactttaggacagatggctcaacatcctaactataaaactccttcctcctttcctgcttacattcatttctgttgcaaccaaaaacctttaatgacatgctgagaaattttgcaccttgacatattctgttccccaccttaggagcttctctaggagtcataatcactcctggctgtaccttgggctgcatccagatctgccccaatgccaccacccccagctctgtgggctctggctctaagactacagggacccagaagcaggaaagagtggcatcatggaattccatgtcctttagggcaggtgggaggtactatgcctcttctccatccaagaccgctcactacatcctgtcctcagatatggctcttgggaccctcaagtcagatactcctaatttttcatctgcttttgctctacagacagaaagaggaggtgccaaagaaatctacagattcattcaaatccttattaaaaattctcacagactttttttttcagaaacagaaaaattgatcctcaaatccataagaaattacaagaaaccttgaatttccaaaacaatcttaaaaatggagaacaaagttggaaggctcacacttaatattttaaaaattcactacattacttctcagccttttggctaagatcaagtataaaacttactacaaagctatggtaatcaagactgtgttttattggcataaggatagacatatagatcaatgtaatggaattgagagtcttgaagtaagcccatatatctatgactaattgattttgacaagtgtgtaaaaattcattagggcataaagagtctttttgacaaatgatgctaggacaattagatatccacatgcaagagaatgaagttggacccctaactcacgtcatatacaaaacttagctcaatatggatcaatgacctaaatataacaactaaaactaaatacacctagaagaaaatttagtggtaatctttatgaccttggatttggcaatggattcttacatatgacatgaaaaaagtaagccacaaaagaaaaaatacttaaattggacttcacgcaaaataaaacttttgtgtatcacaagccactccaagaaagtgaaaagacgatgtatagactgggagaaaatatttgcagatcatatatctgcgaagggcttaaaattcagaatatgtaaagaacctctacaacccaacaaaaaatccaattttaaattgggcaaaagatctcaacggacatttctccattgatttacaaatgtctagtaaacacataaaaagacgctaagcatcattagtcattggggaaatgcaaaccaaaaccacagtcacgtattacttcacatccactagaatggctatagtaaaaatcctggaaaataacaagggtgggcaaggatgtggaaaatttggaactctcgtacattcttggtgggaatgtacaacgataaatctactgtggaaaacagtttggtgactccacaagaagctaagcataggaattgctgtattatccagtaatttcactcctagtatacattgaaaacaggaactcaaacagatacttatgtgccagtgtatattgcagcataattcacaatagcccaaaggtagaaatcacccaagtgtttttcaactgatgaatatctaaacaaattgtggtgtatacatacaataaaatattattcagtcatacaaaagaatgatggtctgatacatgttaaaatattggtgagccttaaaaacatgcttagtaaactaaaccagacataaaatgagaaaatctgtgtgattctactcatatgaattgcctagactaggccaattcataaagccaaagaggagatcagaggtcaccaggaactgtgggaaaggaaaaatagggagttactgcctaatgagtccagagtttctatctgtggtaatgtaaaagttttggacacagaggtgatgcttgcacaacattgtgaatgtagttagtgccacagaattgtacacttaaaatggttaaaatgacaaatttgttatataaatgttatcacaataaaattaaaacaaaataaatgtgtaaattaaaaaattaatattccagaccataaaaacatgcagcatggaaatgactgtcattagataagaacaggttaaacttttaattttatatgaaatgaacataaagataccaattttaaacccagcacatgaaaatttgatatcaatagaaacaggaaaggaaaaagatctgcaataaagcattaaaatagagtaaaaagaagaaatgagaagatagaaaacaatgcaatcacaattgtattgagtgtaaaaatgtttctcaatagtaattttgagattacattattaaataaagtgtcaaaaatgaaatatttgttttctacaagagacatttaaaaataaaatgcagaagtgttgaaaatgcagaggtggaaaacacacaatttagaaatgataaatgcttgaagtgatggatcctaaatatcttgacttttattacacattatatacatgaaacaaaatatcacatataccttacaaagttgaacaaatattatgtatcaaaataaaataaaataaaatgtaacaaaattagggaatttaccaagggtgaaataaaatttaaagcaaaaattttcatggcaaacttttttaatatcagtaaaaataaccataaaaaagtaatgaccatgaataaaaatgcaattatcaacattgcttcaaattaaatgcaactacaaataaaataattatgagcataaagaaataaatcagtaattgtaagtgtaggtttactaatttaactattggaaattgtcatatattaaagacgtaaacaagtaatatcattaatattgttcatctaatgcatatacatttaactttaacacatcaaactcatttaaagaaaatcattcacaaaaatggatcatgtattgggccaaatgaatcttatcctaggccaaatatcatacacatatgctgtctgactcaaataaaataagatatcaatacaaaagttacctttaaaaatctcattattgttaaatatctcttgcattaaaaggaaagtgtaaagaatattttgaaattatttgaattgaatacaatataagaaccatgtgccaacatttgtggaatacatataagttgatatttgggcagaaaacatacaattttgaatacctttactaaaaaaaaaaagaaagattggacaaagctagtgaaacaaacaacttttgccttcaaaagtatggcaaaccattatcctaagcaaattaacacagaaaccgaaaaccaactatcacgtgctcttgcttataagcgggagctaaacattggttcacacagacgtaaaaatgggaacaatagacactggcgactaagtggagagggagggatggcaggggtcagggggcaaggactgtcaaactacctattgagta

SEQ ID NO: 365 - DNA, 211125 bp, Homo sapiens
cacacccggctaatttttgtatttttagtagagacggggtttcatgttgaccaggctggtctcgaactcctgacctcaggtgatctgccctcctcggccttccaaagtgctgggattacaggcacgagccaccgcgcctggacttaatgttgtatttttagtagagatggggtttctccacgttggtcaggctggtcttgaactcccaacctcaggtgatccacccacctcggcctcccaaagtgctgggattacaggtgtgagccaccatgcctggccagaacattttcattatcctaaagcagaacccattagcagtcactccccatttccccctttcctggtccctggcaacctctaatgtaccttctgtctctttgaattttctggatatgtcatatgagtggaaacacataatatgtgatcttttgtatctttcattcagcatcatgtttcacagctcttccatgttgtagcaggtgttagaatgttattcttttatggctgaataatattccattctatggctaggccacacgtttctttacatattcctttttatggctgaataatactggagcctcttgaaccatcatctttgaaatctgtgaagttccaaagaagactttggacagcccaactgccctgtgcttctcttgaagaagccaatattggaccatattttggttttgttaggaacacagcacccattatataagagctagttcaaagtcactgcttcttgaagagagaatactttcaaatctgtctccttgtcgacgcccgtcctgactagttgggtccctgcgaacaatgaccaagctctccctggtgtgggtagagggtgattctcccagctggaggtcacctggggcaagatcctcatgaagcccaagcagatttagggttcccagccaacaggcagtcctcacatctgggctcgctagaactgcacatggagcttaccagatttaccgagacccccgagatctcagccacagctggctcccctggggtcacacacctgtccggagccagtgagcagcaccctcttcacctgtccaggtgagcacggctgggtgcagcttgtggtcctgtggtcctgctgtggatgctgaggtcaagggctgcaagtggcgggctctacaggacttggctggcccagcagagtggtgtttcaaagaaatgaagtgaaatcttacccagagcccctgtgtgtgaagcagacgagaagggggctagtctgtttggagcacagggagcccctcaatgcccctcggactccaggatcaaggaacccacctcagatcaggtgcagcctggctaggaagggtgaggcgccagggaggacacctgccctgcttcctgcttgttgtgcctcggacagcaccaggttccggaggcttcccactccttgggagggctcaatgggtcctgggggaatgtgtgctgcagccaatggggggcagtgctgagcggcgggctcctcagacacctgggcactaaggccccctggggctgccagctgggtcggctgtggtgcttgccccatgctctgtacactgccacatacaggcacccttctaagcacttcactgaactcaactcacccacttgccctagcaggtaaccaggcagataatgtcactgatccgttttatagatgaggaaagtgacatgcagagttcatgcctgggtccatggagcttgtcagcggggcagctgggcttcgaccctcagtctggcttcagaccacaggccctgaccatgacgcagcccctctgtcaggggaggcctggtcattgggaccagctgtgtacccaggtggcaccttccccgggtagcttggaggatcacagcccctctgttcaggtggcaggactgggctagcccaggctggtcgcctgcttccagcactaaacctggttgtcttctggaaagagtacagagctcagacgctgggagcttgggcaggcaaatgggaaataacgggaggctgcacggtgcacctctgagctggggatctgacagccaggctatggggaggggcctttccatcctgctcttgaggtgcacacagcaccagagggtgagcccaggggccgagtcaccacagcacccatgtgcagggagattcttggtgggggccactgaccagggcggtcctccccgaaggagttttacaaaataaccctttgtataaaatcagcttcgtatttttctctacagaggtgtaatttgacataaattgcacccatttaaaatgtataatttggtacattttgatgtttgtacctgtgaacctttaccacagtcaaggtgagtatactgattacccccaaaaggttcctcgtgcccttccctgcccctgggcaaccattcattggtgttgtcactgtagattagtttgcatcttgtggaatttaatataaatagaatcatgtggtatgtcttctgtctgcttctctcatgaaggggtgggttgcccctccacacctgtgggtgtttctcgttaggtagaacgagagacttggaaaagaaaaagacacagagacaaagtatagagagaaataaggggacccagggaactagcgttcagcatatggaggatcccgccagcctctgagttcccttagtatttattgatcattcgtgggtgtttctccgagagggggatgtgtcagggtcacaagacaatagtggggagagggtcagcagacaaacatgtgaacaaaggtctttgcatcatagacaaggtaaagaatcaagtgctgtgcttttagatatgcatacacataaacatctcaatgctttacaaagcagtattgctgcccgcatgtcccacctccagcccaaggcggtttttccctatctcagtagatggaaggtacaattgggttttataccgagacattccattgcccagggacgggcaggagacagatgccttcctcttgtctcaactgcaagaggcatgccttcctcttatactaatcctcctcagtacagaccctttatgggtgtcgggctgggggacggtcaggtctttcccttcctacgaggccatatttcagactgtcacatggggagaaaccttggacaatacctggctttcctaggcagaggtccctgcagccttccacagtgtttgtgtccctgggtacttgagattagggagtggtgatgactcttaacgagtatgctgccttcaagcatttgtttaacaaagcacatcttgcaccgcccttaatccatttaaccctgagtttgacacagcacacgtttcagagagcagggggttgggggtaaggtcatagattaacagaatctcaaggcagaagaatttgtcttagtacagaacaaaatggagtctcctatgtctacttctttctacacagacacagtaacaatctgatctctcttgcttttccccacactctcactcagcataatcatgctgatatttatccaagtctaaaatcctttgatattcatccgtgatacacatccatgttgcatgtgtcaaaagcccattcccctgtacggatctaacacagcctgtttatccattcacatgtggatggatttctggatcatttccagtttttgctcatacaaataaagccgctgtgaacctttgtgtacaaatcttggtctggacaaatgcttccacttatctcgggtaaatacctaggagggggatgactgtgtcatatggtaggtccatatttagctctttaagaaactactggccgggtggggtggctcacacttgtaatcccagcactttgggaggctgaggcgggtggatcacaaggtcaggaggtcgagaccatcatggctaacacagtgaaaccccgtctctactaaaaaatacaaaaaattaacagggcatggtggcgggcgcctgtagtcccagctacttgggaggctgaggcaggagaatggcgtgaactcgggaggtggagcttgcagtgagccgagatctcgccactgcactccagcctgggcgacagagcaagactccgtctcaaaaaaaaaaaaaaaaaaactaccaaactcttttccaaagtggttgcaccatgttgcattcccaccagcagcatatgggagttccagttcctccacatccttgtcaacacttgagattttttgttttaaattacagccatcctagtgggcgtgaaatattatctcactgaggttctattttgcatttccataatgactgaagatgtggagcatctattcgtgtgcctgtttgctgacaaaatatcttctttggtgaaccatgtgttcacttattttgtccaatttgtgaatagggttttttttttattattgagttttgagatttctttgcgtatttaggatatgagtgttttaccagatatatgatttgcgaatagtgtctcctagtttgttgtttgtgtattttcttggaagcgtccttcagaggctgggcatggtggctcgcgcctgtaatcccagcactttcggaggccgaggtgggcagatcacttgaggtcaggagttcgagaccagcctggccaacatggtgaaaccccatctctactaaaaataccaaaacattagccaggcatggtggcgggcacctgtaattccagctactcgaaaggctgaggcaggagaattgcttgaacccgggaggcagggaggttgcagtgagctgagatcgtgccattgcactccacctgggcaacaagaacaaaacttggtctcaaaaaaaaaatttccttattatcctttttattgttgttgagatggagtttcactctgttgagcaggctagagtgcagtggtaagatcttggctcactgcaacccctgcctcctgggttcaagcgattctcctgtctcagtctcccaagcagctgggactacaggcacctgccaccacgcctggctaatttttgtatttttagtagagatagagtttcaccatcttggccaggatggtctcgaactcctgatcttgtgatctgcctgcctcggcctcccaaagtgctgggattacaggtgtgagccaccgcgcctggcctcttgcttactttaggtttaatgtgctctttttctggttggttaatgtagcagctgaggtcattactgtgagatctttgctaacacagatgtttagtgctacacattttccccaagtactgctttagtggcatctcacaaattataagttgtgtttttgctttcattcaattgaaaacactttctaatttccctttagacatctttcttaaacagattttagaactgtgtttagttttaaaatatttgaggatttcccagaatttttcctattgattttgttttgttttgcttttctgagacggagtcttgctctgtcaccaggctggagtgcaatggcacaatctcagctcactgcaacctctgcctcttggtttcaagagattctcctgcctcagcctcccgagtagctgggactacaggcatgcaccatcacgcccagctactttttgtatttttagtagaaatggggtttcaccatgttggtcaggatggttttgatctcttgacctcgtgatccacccacctcggcctcccaaagtgttgggattatgggcgtgagccaccaggcctggccttcctattgatttctaattgaatttgattatactttgcatgcttaaattcttctcaatttattgagatctgtttgcatggagagagaaatcctactctattcctcttcttataggccactaatcctattggattaataattcacccttacgattttatttaaccctaattacctcctagaggcccttcctccaaatacaggtatattaggggttagggcttcaacgtaggaacgggggtgggcaccattgagtcaatagcaggatatgggatttatctatttttcctgcagttcttttacgtattttgaagctgtgttattagaggtgtaggcatttaggattattatgttcattagtcgactccctttgtgaaatgactatatttgattttctttgctttgaaatctactttgtcttgtattaatgtagccactctagctttctttttttttttctttttttttttgagatagagtttcactcttgttgcccaggctggagtgcaatggcgcgatctcggctcactgcaccctttgcctgtgggttcaagcgattctcctacgtcagcctcccaagtagctgggactacaggcccacgccaccatgcccggctaattttgtatttttagtagagatggagtttccttatgttgcctagactggtctttaactcctgggctcaagggatctgcccacctcagcctcccaaagtgctgggaattgcaggcgtgagccactgtgcctggcctccagctttcttttgactagtgttagcatggtatatcttttctatcctttcaagctttttttttttttagtagataatgtctttttgcacataacttattgttggatttgctttatttttccaacctgccaatctgtcatttaccaagagtatttatttttgacattcgtatttaatgtgcttagtcatatagttttgagtctgtcatcttgcaatttgttttttgtttcatctgccctttgttctctctttacctgccttcctctgggttgagtattttatgtttctgtcttacctcctttgttggcttactaggtatctttgctgggttttgaatggtccctctagggtttaggcagcacttggctccgaattgcaacagtggcctcttttcccttgttgtccaggtgaatgagtggcaggatgactggccgacctttttcgcccggcaccggctccaggcgcagctggacctcattgagaaggactatgctgaccgagaggcacgagaactctggtcccggctacaggtgggcacggcagtgacttctctgggaaagagctggtcctctcatgatcccgccgcatttgtgcgggttcatctgtaaaacggagctggagcagggaacactgagtcctggagcacacatcagggaggaaggggggcaggggcgggggttcccccaaaagggagtccgaaaggagtgaggagtgaagacacacttggctcctcgtgcccctctccactgctaggtcaccaggtatttagcctcagactttcctcatgtgaaacacaggtgcttgtaaatggtggtgtttaccatgattactgttcttactatcagtaacacttgtccactccatcgtgttcctctcccatgggaagatgtgggtaccagatgatccagaatgactgatttcaaaacataactctcggccgggcacagtggttcacgcctgtaatcgcagcatttgggaggcctaggtgggcagatcacttgaggtcaggagtttgagaccagcctggccaacatggtgaaaccctgtctgtactaaaaatgcaaaaattaaccgtgcatggtggtgcatgcctgtaatcccagctactcaggaggctgaggcaggagaatcacttgaacccgggaggcggaggctgcagtgaggggagattgcaccattgcactccagcctggacgacagagtgagatcctgtatcaaaaagaaaaaaaatcaaaatataactctcaaaatgttaaaaaagaatgtgcatgtcaatccagagtgagtatacatcaaagagacttgaactcattaatgaagaaactaggctgggcacggtggctcaagcctgtaatcctagcactttgggaggccgaggtggatagattttacctgaggtcaggatttcaagaccagactggccaatatggtgaaaccccatctctactaaaaatacaaaaattagccgggtgtagtggcgggtgcctgtaatcccagctactcagtaggctgaggcaggagaatcacttgaatccgggaggcggaggttgcagtgagccgagatggcgccactgcactccagcctgggtgacagagcaagattccctctcaaagaaaaaaacaacaaaaccaaacaaaacctgcagacatatatgtgtagcgaaataaaagtggccagagtttgctaaggtagcgcaacactggttcctattctgtgggtcgattaaaactataacctcagaggttctccactgtgtggggattctagacctaaattaggaggaaatcctaagttagacaaagctagactcccctgaagtcaggtggcccctatttctgggcttggcaggcagtgctggggctggacaccgaagcagatcgcgagtgggctttgccttatttccaagaacgaggtgatgagaccggggctcccagaggccagcgataactgcagccgttgctctcgtaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttccttgggcaccatgcgaaggctgctcaagtagcggcccctgccctcccttcccctgtccccgtccccgtctccgtctccccgtccctgtccccccgtcccccgtccctgtgcccccgtccctgtccccctgttcccgtctccccgtccctccgtctccatccccccgtccccccatcctcctgtccccgtccccccgtccccgtccctccatccctgtcccccgtccccctgtccccctgtccacataccaatccccctgtccccgaccccccatccccgtcccccatctccgtccccgtcccccctgccccgtccccgtctccgttcccccgtccccatcctccatccccgtctcccatcgccgtccccccgtccccgtcccccgtccccgtcccccctgtccctgtcccccttcccccgacccctcccagatcctggggaccaataaagcccgcagcgggtctcggctggcgtcctgcgcctcgttcctccgctcgtggggctgctttcagggccagacgcacggcgagctgtgcacggacgtttttgcggcgattcaggggaaacgcacgcggacccggtagccaaggccaaagtcggcgcagcgcccaccgcggcctccgggccccgctcccgctcccgctctggggcgcgccaccactcggcgcggggcccgtgtgatccgcgcgggtcccagcgtggcgcgaataagtgtcagggcggttggctctgaggggtgggtcccggggctcgcctcgcgcccccgactgcgtgctcaggccccgcccctccccgtccacgcatgctgaggctccgccccgctccgcggtcccccggtcccacccgcccccgccccgcccccgccccgccccccggcgtgttgtggctccgccccgctgtctccggccccaccgcaagccctgcccctcccacccacgcgtgcccgggccccgcccccgttgcgcgcagccccgccccctatcgcgtgctcaagccccgccctggcggcccccggccccatcccgaagccccgcccccccgcacaccgcctgctcaggctccgccccgctgtcctccggcggcggcctcaccccgcagcccggcccaccgcgtctcaggccccacctcctgtcctgccccgcccaccgcgtgctcaggccccgctgagcggtcccggctccgctcgcgccctgtggggtccacggcgcgctcttccagagcctttgggacccgtgcccgctcgcgtcctcaagtgcacgcgccgtcccgcgcgcggtattttggcggccgacgcgttccgtagcgaggccggcgagtggggtcggaggtcgcggggcggggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcggtgcgtgggcggcgccgcgtgcccgcttcctcccccggcccgggttcggcgcgctgagtgcactttaccgggcggggaccgcagcccggcggcgccggccgctctgcgagggctgccggtgcgcggtcccgcgggccgtggtggggcgcggccttcctaggcgggagagggccaccccggcgcggcgttaggtgcacggggcagacgcgcgcctcccttggggggaccgtggcccgcggagcgcctgctctcgcacggggtgaagcctctgcggcctccccgggaggcggggtgcagaagccctccgtcccccgtctccgtcactggaggaggtccctgggctggggagactcgggccagacccctccggacagctggtcagccctgcagtgtggactcccaggcttgcctccaccgagcgcggtttctgtgaatgttgtgtggacagggagatagggaatgagagagggggacgcagggaacaaacctgctgcaaacaaagcgcgcctcgggtggggagggcagcagcctgtccgttccgtggacgccgtggacagagcgggctggccgggtccgtgcctctgcaggcggggtggggtgtaggtacccctgtggaggccattcgatgagtctaaattctccgagttcagacccacctttaccgctgtctataatgggttatttccaaacaagtccttaggagctcatagctaagtagttacatggggttttgtaattcagtaaaatcatctttgtagaccctttgagtaagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttcttccttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccactgcgctcggccccagtgggttctttctgcgggctgcccagatagagttgatttgtcagggcaggggagttgccatggagaagatttagttcacgcagagccggttgaaagggagactagactagaggtttttttttttttttttgaggcggagtctcactttgtcccccagggtggagtgcagtgatgagatctcagctcactgcaacctccacaacctccacctcccaggttcaagtgattctcctgcctcagcctcccgagtagctgggactacaggtgcgcgccaccacgcccacctaatttttcgtattattagtagtgacgggtttcatcgtgttagccaggatggtctcgatctcctgacctcgtgatccacccgcctcagcctcccaaagtgagccaccacgcccggctggagttttattattactcagatcagtctccctgagaatttgagggccagggttttttagaggtaatctgggggaaagggtgggggtggctgattggttaggggtatacaatcataggggagtcggaaatgatcctccgtgatgtgctgaatcgcgtctgcgtggggccccaggagcagtgggcgggtccaggtggagctatcatgggtccgtggatcctagtgtaggtgtcagacatggaaacaatctgaaaagatatctttaaaggccagtctcaggttctgcaatagtgacatggtctgcaggagtaactggggaactcgcatgtcttgtgatctcaagaataatggctggcaattaggttacgccttagcggaattcaggctcctctcctcctcctagcctggtggcctctcattaactttacaaaggcagttgagttttggggaagggctcttagcatttaaactataaattaaatgtctcccagaggtagcttggcagcttgaagactaaaggcatgagggggttgcctggatcagatctgccccattgccataatttcctcacagatcacttttgcaaaggcagttttgctgggaagcagtgggtgtgttcagatgtggaggtgggagctgccggattggacagaagcagtttcagctgctgagaggaggagaaagcggtggttcagggtctgggaggttgtgaagagctggcagctgtgtggaagggagcagtgcctggatatgtcaaccaaaaagtatctgagacgagtctcaatcagtttagaaggttaagggtgtgcccgtgaggcagcctcaggaggtcacatgtccccaaggaagtcgggctacagcttagttttacacgttttagggagacgtgagacatcaatcaatacctgtaagatgtacattggtctcgtcagggaaggcgggacatcttgggtgggagggcgtccagggcattggtggattcaaatatttcacgattggtgattggttgaaagagtttatctgaagacctggaatccatagaagggattgtctaggttaagataaattgtggagaccaaggtttttcttatgcagatgaaggttccagttagctggtttcagagagaatagattgtaaatgcttttcatcagactaaaaaggtaccagacttagttaattttctcttggatcagggaaaagacctagaaaaggaagggattctctacagaatgtagcttttcccagcaagagacaacttagcagaaccatttcaaaatatgtcaaatatattttagggaaaaatattttgatttctttcagggcctgctgtctgtcatgtgatgctgtactagagtcaggctggaatttggtgtcttattgctacttaagatcggttttaatgctaatactgatcagctgtgcctgaattccaacgagaggagggtataatgaggcctatgtggaccactccccacaatcccttaatatcatgaggcctgaactagtttttcaggttaagtttggaatgcccttggccaagaggaggggtctgttagatggctagggggcttagaattttgtttttagtttacaggcatgtttggcaggggagtgtgagaggagtgccagggatgtgtgtctcacaaggacagagttgagcttggcccttaacggctggcagaggcaggagagagtgaaggaaggaagaggcgaggaggagactctgttaggaagagtatcgaggcagtgggaaaagaggaacagtgtgccaagcaagtaaactgcacgaggctgggccacagtggccctcaaaaggctagagggaggtggggcattccctccaggtggcctgtgtggcctcctttagtgagaggggaggtgtgctcttgagagctggggaagaggtggagctgccctgtggaagctagcaagggaaaatggggtttctgaggctcatgggtatgtttggcctagtgataattaattttcatgttatatttgtttttagtaataatggacaaataccaggagcagcctcatctgttggacccgcaccttggtaagaatagaagctgctgattttgatcattcagttacagatgaccacggaggccttggtgtgtggtgctggcacatgcatgtgctttgccaggatcaaatgccaagaagtgtccctgtcttgcttgcctggctggttggttttagccgacctgtgatagtggcttgagttccagatgtcactctaggctggggggagatgtgtctgagctacttaattcctttctgctaaggaaacaacatctgctcctcatgtgttttttttgtttttttttcttttttttgagacggagtctcgctctgtctccaggctagagtgctgtggcgcgatctcagctcactgcatcctccagctccctggttcaagggattctcctgcctctgcctcccgagtagctgggattacaggcatgcgccaccatgcccagctaatttttgtatttttagtagagacggggtttcactatgttggccaggatggtcttgatctcctgacctcgtgatccgcctgcctcggcctcccaaagtgctgggattacaggcgtgagccaccgcgcctggcctcctcaagtgtttttagtttacattagtttattattttagtttacatttgggcacatgatgtttttctggtaatagtcatacagggtcaggtgttttacatgggtcatcatttaatcctcacagcagctaaggagggcatctgttgtcatctccagtttacagatggggacactgaggctcggttttcttactttagtgtaaggggtgtggtttcttattgttttctttatttttgatgtatttcacactgattaaaatttttctttttctacctacaaatgtgacacatgcttctggcagttcacctgggaaagaggaaggtggcaatagtcaccacgttgagagggagcaccctgggtgggggcaccctggcttcatagcccagtttcaccattcagtttttgagctgctctttgccggggtttcctcgccccccgtggtgttgagatctgtgtgagagacactaagggtcagcctttcatgtgcgcacacgtgcctcttaaagagtagtttgtgctgtgcatcttgttctgtttttttttcttcaaataacagattttggctgggggtggtggctcatgcctgtaatcccagcactttgggaggtggaggcgggtggatcacttgaggtcgggagttcgagaccagcatggctaacacgatgaaaccctgtctctactaataatacaaaacgttagctgggcatgctggcagttgcctgtagtcccagttacttgggaggctgaggcaggagaatggcgtgaacccgggaggcggagcttgcagtgagctgagatcacgtcactgcactccagcctgggtgacagagtgagacttcatctcaaaaaaaaaaaaaaaccaaaaaaaaccctctaaattcgggattcaagaattcattgggatcagacttgtccttctgtcctagaaaaatttataggccttgtgaaggagaccaaagatagaggtccttgggagagggtcagctgcagggaacatgactctgacatctggtggaggggctagccatgctggatggcgtggcaggcagtgggctccccaggccatatcttataggaggtcttgggttcctggagttcctgtgtgtgagcgctggttcccaggaaacagatgtggtcactgctcacaaggtagcgggtggtgtttttatatctcttcaagtaacaacgttggacctgtagttaaatgcctttattcttgccagacctctttccagagtggatcatggaatattaacacttgttgtgagctgcttagagtactgcgaatgatttttagagttattttctttctttgcaaaaactgtttttcgccgggtgtggtggcttatgcctgtaatcccagcactttgggaggccggggcgggtggatcacctgaggtcaggagtttgagaccagcctgaccaacatagtgaaaccccgtatctactaaaaatgcaaaaattagccgcgtgtggtgcacgcctgtaatcccagctacttggggctgaagcaggagaattgcccgaacccaggaggcagaggttgcagtgagccaagatcgtgccattgtactccagcctgggcaacaagaacgaaaacgtctcggaaaaaaaaaaaaaaaaaaataaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttcttttttttttttttttttgagatgtagtctctctgttgcccaggctggagtatagtggcccaatcttggctcactgcaacttctgcctccagggttcaagcgattctcctgcctcagcctccagcgtagctgggattacaggcgtgtgctaccacgcctggctaattttttgcatttttagtagagacagggtttcaccatgttggccaggctggtctcaaactcctgacccccacgtgatctgcccaccttggtctcccaaagtgctgggattacaggtgtgagccattgtgcccggcctgcttttgccttttaatattgtgtctggtgtattttatctactgaagttttttcgtgtttgtttttttaaagagatgggatctcgctctgtcacccaggctggagtgtagtggcgcagtcatagctcactgcagccttgagctcctgggattaagtgatcttctcacttcagcctcctgcagagctgggacaacaggcacaagctgccatgcctagttaattaaaaaacttttttttttggccaggcgcagtagctcatgcctctgatcctagcactttgggaggccgaggcgggtggattacaaggtcaggagttcaagaccagcctgaccaacatggtgaaaccctgtctctactaaaaatacaaaaattagctgggcatggtgaagcatgcctgtaatcccagctacttgagaggccgaggcaggagaattgcttgaactgggacccaggacgcggaggtagcagtgaacgagatcgtgccactgcactccagcgtgggctacagagccagactgtctcaaaaaaaaaaaaattttgtttttgcagggtcagggtcacgctgtgttcctcaggctggtctcgaacttctggccccaagcaatcctgccttggcctcccacagtgctgggatgacaggtgtgagccactgcacccagtctctactgaagttttagaaatatttagcttgtcaaactatcagtttctttgtgtttggcctttggtagtacggttagaaagtttatttttcctaatcagttatgtaagcctcatttattggatgatttagtggcctctcccctacttgaaatgccattttaaatctatattaaatattcaaatatattagcctttgcttttagattttttatcctgttccattgacctatctgtatgctcttttttctgggtcatttcgtttgtttgttttttttttttttttgagatggagtctcgctctgtcacccaggctggagtgcagtggcgtgttcttggcttactgcaacctccgcctcccaggttcaagagattctcctgcctcagcctcccgagtagcatgtgccaccacgcctggctaatttttgtatttttagtagagaacggttttcatcatgttggccaggatagtctcgaactcctgacctcaagcagtctgcccgccttggcctcccaaagtgctggaattagaggcgtgagccaccacgcctggcctgggtcattttgtttgatgttagtttatattttgcctggcatcctttcctcttattttcttgatggttttgtagcccgttcattaatgcggatgaactccggaattattttatcactctccaccctttggaattctattaaattcacaaattcatgtaggggagaagtctttctaagatttaattttcatgtctaagatcatggtattatgtctctaattattcacatcttttgtgttcctcagtgaaggttggtgattttctttagatgattcctggagacttttttttaggtttatttctaggtatgttttgtcttttattgctcttgtgaaactatttgttatgtgttctaactagttattgctgatgtctagtgaagatatgttttgtatactgtttttgtaaatggcaacactgtaatggaatatgtatgtgtaaacatacatttcttaacatctttatagggatataattacatactatagagttcactcttctaaatatacattttagtgttagtgtattagtgtattacagagttgtgtaactatcactaccacaatctaggcattttcatcatctgaagcaacccaactcccatcaacaattccttcccattctctgcttccgcagtaaccactcatctggctctgggtttgtgtgtattcagcattttgtgtgatggaatcatgcagtaggaggtcttttggcactggcttttttcacttagcatcatgtctatgaggttcactgtgtgatgaaatgtttacttcaatagtttttcagtctttttttttttttggagacaaagtcttgctctgtcacccaggctggagtgtaatggcgtgatcttggctcactgcaacctccttctcctgggttcaagcgattctcctgcctcagcctcctgagtagctgggattacaggcgccacctgtaaaattagcctggccaatttttgtattctgagtagagacagggtttcaccatgatggccaggcttgtcttgaactcctgacctcaggtgatccacctgcctcggcctcccaaagtgctgggattacaggcgtgagccaccgtgcccggccagttgtttcttctgggttttcttagcaggtaaatattatatggtttgtaaataatgctactctttatccacgattataaatttttattcttagaacattttattgagttttaattttattgagtttaaaatttacctactataaaatgcacccattttagtaagatgtttgagtttcggtaaatgtatacaccccgcgctatcaagatatggaacatttctgtcatcccaaggagttacttgatgtccttttgctgtcagtcccctcaccccagccctagggaaccactgttggttaatggtactgttcattagttttgcctgttctagaatcattcagtatgtgctctttttgtcttccgttgttaaaataacatctccgggacttaccattgttggtgtgtgtatcagtagtttgtacgttttctctcgtgctgataaatcacaatttgtttcttcttttttttttttgagatggagtcttggtctgttgcccaggctggagtgcggtggagtgcagtggtgcgatctcggctcactgcaagctctgccacccgggttcacgccattctcctgcctcagcctcccgagtagctgggactacgggtgcccgccaacacacccagctaattttttttttatttttagtagagacggggtttcaccttgttaaccaggatggtctcgatctcctgacctcgtgatccgcccgcctcagccttccaaagtgctggggttgtttcttcttttatctgttgatggacatttgagttgtttccggtttttggctgttattaataatgctactttttgggaggctgaggtgggcagatcatgaggtcaggagattgagactatcctggctaacacggtgaaaccccatctctactaaaaatacaaaaaattagcccagtgtggcggtgtgcgcatgtagtcccagctacttgggaggctgaggcaggaaaattgcttgaacccgggaggtggaggttgcagtgagccgagatcttgccactgcactccagcctgggtgatagagcgagactccgtctcaaaaaaaaaaaaaaaaaaagtaatgctactgtgaaaatgtttatgtacaagtttttaggtagacagaggttttattttctcttgggaaaatacgcatgtgtggaattgctgagtagcagaaagtgtcttacttgtagaaagtgtatgacttggccaggcgcggtggctcctacctgtaattctagcactttgggagactgaggcaggtggattgcctgagctcaggagctcaagaccagcctgggcaacatggtaaaaccccatctctactaaaatacaaaaaattagccgggtgtggtggcaggtgcctgtagtcccagctactcaggaggctgaggcacgagaattacttgaatgtgggaggcagaggttgcagtaagctgagatgacaccactgcactccagcctgggtcacagagtgagactctgtctccaaaaaaaaaaaaagtgtgtgactcatcacctgccatactgatgccatgaagattgtactgttgaccatttctaccaacaaggtatgaggattccagctgctctgggttctcttcagcactcagcgttgccagtctctctgatttcagggagtgtatctcgttgtgtccttctctgcgtttcccggatgccagttgcagttgttttccatgtatgaagacttgcagcccagcgtatggtctgttttgttgaacattccgcgtgcacttgagaaaaatgtctgttctgttgttgggtagattgttctctaaatgtcacgtaagtaaggtgggtgatagtgctgtttaggtttcagcgattttctcttacttgttctatcagttcctgaaacaggagtgtcgaagttttcaaccgtgtctcctttcatttctctcagcttcttctgtgcttattttgaagctctgtaggttggtgtgtatacttacagaattgttaagtcttcatgatgaattgatccttttattatcatgaaacattctgtttatctctgatggtaatgcttgttctgacatttactttgtctgatattaacagagccactccagctcttttatgatttgtgattggttggaatatctttttccttttgcttacgtttaacctagctatgtctttttgtttgtttttgttttttaagagacagggttttgggccaggtgcggtgggctcacacctgtaatcccatcactttgggaggccgaggtgggtggatcacctgaggtcaggagttcgagaccagcctggccaacatggtgaaaccccgtctctactaaaaatacaaaaattagccaggcgtggtgacgcgtgcctgtaattccagctacttgggaatctgagggaggagaatagcctgaacccgggaggtggaggttgcagtgagctgagatcacgccactgcactccagcctgggggacagagcaagactctgtctcaaaaaaaaagaaaaaaaagagacgggttttgctctgttgcccaggctggagtgcaatagtaggatcatagctcattgccgccttgaaattctggcttcaaatgatcctcccaccttggtctcccaaagtgctgggaaaacaggcatgagccaccacacctggccggcctcaatgtcatgttgatgttcacttttacagtaaatgtttcctatgtttttccctagaatggatgatgaacttgttgttggacatagtgcaagatcagacatctccagcttcccttgtacatctggcttttaaatttctttacatcatcaccaaggtaacatttccatagcacttcagagttgacagatacttttgtaatatacttggtccagaggttaccctccaaaatgttatttctcaagaaagatagttcttagacacaagttgtgggtttaattctgtccctttttactgtatgttggggatcagaatttagtgatgtgggctctttggctgaaacagtgtcaggatattcagcatcttgcatttgaatagattgaagcactgtgtagctaggaagggaatggggtggagatgagactaaatcagaaaaacttcttacaaggagaaagcaggccgggtgcggtggctcatgcctgtaatcccagcactttgggaggctgaggcaggtggatcacctgtggtcaggagttcgagatgagcctggccaacatggtgaaaccccgtctctactaaaaatacaaaaattagctgggcttggtggcacatgactgtaatcccagctgcttgggaggctgaggcgggagaatggcttgaacctgagaggcagaggttgcagtgagccgagatcatgctgttgcactccagcctgagtgacagagcgagactctgtggaaatggaagtgcttctcacactttaatgtgcagatgaatttcctgggaattttgctgtgctatagattttgagcaagtaggtctaggcgggggtctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgctcatagtctgcttttcttacaagcttgcgggtgtctgctcatagtctgcttttcttacaagcttgcgggtgtctgtgctcatagtctgcttttcttacaagcttgcgggtgtctgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgctcatagtctgcttttcttacaagcttgcgggtgtctgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccagcgagaggacactgcgggtgagctgccaaggacacgcaggcctctgtagctcctctgtttgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctcctgcctcatcctctcagactacaggcatgtgccaccatcctgtctaatttttaattttttatgttgcccaggctagtctccaactcttggtctcaagctattcttttgcctcggcctcccaaagtgctgggattacgggtgtgagccatcgctcttggccatgggtagctttcttggggtgactacggtcttactaaattgtgtcactgtaatgtcacagaattctctttgatcagtgggtcgcgtagctggtgatttttgatgaaagggtagaaaggcaattttgctgctctctgtatttttaaatgttataattcagcatctctttatttgataggttcgaggctataaaacatttcttcgtttatttcctcatgaagttgccgatgtagagcctgttttagatttggtcacaattcagaatcccaaggaccatgaagtgagtgtctctgcctcccccctcgtctccagccctccgtgcctgtccttcctccctgcttgccccaccctgctgcaccttccccttcctgtttctttcattttatctccctttgttttgtgtcactcctcttttctttcttttcttttcacttttcctttacttcttgtacaagttgctttaaattattttcgtttaaaatagcccctttataaaaaaaattatgcctaggtgtagtttaacaataaatccgtcattgtttctatgtttttttaactgtgtaagtataactgtgttgggttcccaagaccacccccaggtttgatacttcctgagcgggactcacagcactcagcatagagtcctccttttggctgtcacttgttatggcaaaataatacacagcaaaatcagcaaagggaaaaggcacatgggtggggtctggggagaaccaggcgggagctcccggggtcctccagttgggtcccacagggcctgtgtcattcccccagcagtgagatgtgaccacacctgtgaggtgtctatcagagaagcacgtttgagacttggtgcccagagctttcactggggtctggccacatggacacctctgcctggcacgaaacgaaattccagacccccagcaggaaagcaggtgccagcgtaaagcacacggtttgtgcagattgagccagcgagggacctcatcaggcagggcttggtgggaaccctgctggtgtccaggtccctggataccagcccagggccggcctcgtcaggggccttgcctcagacggcagcggggcctgctatgctcgctgtcttctgcgtggtatgtatttggaggagcacacggtttataaccgtgcagtgcggtggcttgtctcggcgtggatgtgactgatgagcgctgtggggcatttccctgctgccctgcactccgtgcccttctttccctagtacttctagcgccccccagtggaatgattgcagggacaaattgggatgttttttactaattactgaaaataagggtactccttttttattagaagttgataattgttttctttattcttttttttttaaaaagacagagtttcactcttcttgcccaggttggagagcaatggcacaatcttggctcactgcaacctctgtctcccaggttcaagcgattctcctgtgtcagcctcctgagtagctgggattacaggcatgtgtcatcacgccagggtaattttgtatttttagtagaaacagggtttctccatgttggtcaggctggtttaggactcttgacctcggccaggcacggtggctcgtgcctgtaatcccagcagtttgggaggccaaggtgggcggatcacgaggtcaggagatcgagaccatcctggctaacacggtgcaaccctgtgtctacaaaaaatacaaaaattagcctagcatggtggcaaacgcctgtagtcccagctactcagaaggctgaggcaggagaatggcgtgaacccggaaggtggagcttgcagtgagcgaggttgcgccactgcactccagcctgggcaacagagcgagactccatctcaaaaaaaaaaaaaggaactcctgacctcaggtgatccgctcgtctcggcctcccaaagtgttgggattacaggtgtgaaccaccacacctggccttttttctttattcttaggtgtttttactttttatctgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcaagcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttcagtggggtaaaatcccataggataacttattttgaaattgtgataattcatgtaggggtcaggttgagttagcaaatctcatttctttgtagatgatgcaaatactctgttgagggtaatcatggcagataaggaagggtttagtggcatggtgagagagaataaggacccattttacatttagttcttaacgttatataaataatagatgctcatttgtaggagaactagaaaataaagataagcaagaaaaatactaaatttaaatttatgaaattctagtgccaagagataagttgtttattttctccgaacttttcctgatgtaaatattatgcatataaacacagcttattgtattagttatctattggatcataactaattaccccaaacttgagtgtttgacacacatttatcctcttgtagtttctgtgggtcgggagtctggcatggctgagctgggtcctttgtgtcaagcttgcccacagctgcagttaaaactcgacatgggcaggctttgccccaaggccgttggattgaggccaccctcagttctttgccacctgggcccctccaacttagtgacttattccatcaaagcctgcaagggagaaactctgctaatgagatggaagtcatgataatatgttacctgatcatggaagtgacgtcccattcctctgccagatcctgtggttagcagcaagtcaccgagtccagcctacgcaagcgagcactaggaggctgtcaggctctgagccatctcagttgtctcggtcttcctgccacgctgactgcgacagccctggtcagcattcactgagtgcctgctgtgtgcctggcaccgttcaaacactcatagattaatctttaatcacttatggattaataatttaacctatacattgggctgggcatggtgggtcactcctgtaatcccagcactttgggaggccggggcgggcagatcacgtgaggttaggacttcgagaccagcctggccaacatggtgaaaccctgtgtctactaaaaatacaaaaattagctgggcctggtgacacatacctgtaatcccagctactcaagaggctgaggcagaagaatcccttgaacctgggaggtggagattgtagtgaactgagattacgccactgcactccagcctgggtgacagagcgagagtccatctcaaaaaaaaaaaaaaaaaaatttaacctatacgttgatgattgatagatcatcagtgattaattaactgtgattaataatcattgaattctccttcatgaggctgttgacaattcttaccctcgtttaaccgagaaggcaacaggcataaaaattaataacttagtttactttgctcataaatggtggatccatgtttgaatccaggcggtttatctggagtctgtgctcttcatcagggctcagcattgccccatgacctgctgttctgagtcctttttaccctcagcaacacgttcttagtgtcttacgatgtcagaaagtgtccccctcataatcgttaagggaaaaggtactccattgtaatctaatttaaaattctctctgatagatggatgttttgtttgttcttgttttgttacgttagaggtagtgtggtgatgggctgggtgcggtggctcacgcctgtaatcccagcactctgggaggccaaggtgggcatatcacctgaggtcaggaattcgagaccagcctgaccaacatggagaaaccttgtctctactaaaaatacaacattagctgggcgtggtggcacgtgcctgtagtcccagctactcaggaggctgaggcagaagaatcgcttgaacctgggaggcggaggttgtggtgagccgatatcacgccattgcactccaccctgggcaacaagagtgaaactccgtctcaaaaaaaaaaaaaaaaagtagtatggtttacccacccttgtttacttgtctgtggagagggactgccaggtcaagggagcatggtttgtcaagacttggcactctgtgattgccgttagaaagcctgccccggaggccgggcacggtggctcacacctgtaatcccagcactttgggaggccgaggcaggtggatcacgaggtcaggagtttaagaccagcctggacaagatggtgaaaccccatctctactaaaaatacaaaaattagccgggaatggtggctagtgcctgtgatcctttcatatttattcaactgttctcttacaaatgaacagctacttgggaggctgaggcagagaattgcttgaacccgggaagcagaggttgcagtgagccaagattgcaccactgcactctagcctgggcagcagagcaagactccgtctcaaaaaaaaaaaaaaaaaaaaaagcctgccccagaaaaaaagatcttctaagtgtatcgttatgggaaaaaacaaacaaacaaacaaaaaaaaccgagacaagcattggaaacattttaaggcagccctccgaaaaataaatctagctgggcgtggaggtttcatgcctgtaattccagcactttgggaggccagggtgggaggatagcttgagcccaggagtttgagagcagcctagacaatataatgtgactcagtctctaccaaaaaataaaagaaaattagccaggtgtggtggtacacacctttggtcccagctattctggaggctgaggtgggagggtcatctgagctggggaggttggtgctgcagtgagtttttttttttttgagatggagtcttgccctgtcacccattctggagtatagtggtctaatctcaactcactgcagcctctgcctttgaggctcaagcaatcctcccacctcagcctcctgagtagctgggattacaggcatgtgccatcatgcctggccaatttttgtgtcattagtagagacggggttttaccatattgaccaggctggtctcaaactcctgacctcaggtgatccgcctgccccagcctctcaaagtgctgggattacaggcgtgagccgcagtgcccagcctacagtgagctttgctcacaccactgtactccagcctgggtgacagagcgagacccggtctcaaaacaacagcaaaaaaaccctaagaccagctactggggaggctgaggcaggagaatggcgtgaacctgggaggcggagcttgcagtgagccgagatcgcgccacggccctccagcctgggcgacagagcaagactccgtctcaaaaaaaaaaaacaaaaacaaaaacaaaaaatatatacacctactatgtaccccaaaaattaaacactaaaaattaaaaataactaggtatttgtagtaaatctaggtgctcttcagtttgaacagggcctcttatctagtctgaatactccaatactgatggttcccttgtgctggaaggcatattaggtgctcaatgaatactcttgattctttgttacaattgggtaactcctttgtttacattctcctgctctgttcttgcaaatgtgtgtttcaagggggtgtgaccaaatgctctgtgtagctcaggcacttcctgggtgagtgtagcagttggcagctgtagcccttggctcagattgaagagaggtttttttttgcagctttggacttaggcctgtgctggtaaggtttgtgaacctgggccctcggggagctggtgagggtgggactggtgactgtgtggtgtccccaaggctggcgtgtgcaggagtgaccgtgtctgtgcttcaccctttcttgcagtcctacttgattgtcagtgacaaggcccgagatgcagctgctgtccttgtgtccaggtaagtttccatggcacatttcttggtgtgtggctggtgggttctgagaggggtttgtttgggtacgtgtttcatgtgcgtcttcagtcctcagacgaaggaccccgggaagtctttggactctgtggctttctctgagggagtgtgcagcagtgtttgggcacagaagacctctgaccctgaaatgaccaccctcagtggtggtttggggtgctggtgggggtcacctgacaggcccatcgacaggagtgcaggtctggaagaggcgtggctgtcatccctggggtgcagcccctgcacagggatggggtggcagttatgagaaacatctcgggccgtctcccatggagatgatgggtggtgttgggcctctgtgactggggatgaaaatcccccaacgtcctgtattaactgcaccccccgtgtgccccagacaggggaaggtggttttctctgctgagcgcagcaggcctgcggtgttggaaagataccaaggatgtgtgtatagactgagcgaacctgtttcatgagatgcaagaaggaagaaagcaatatttctaatcagtattttacatgacatgtgattttaagtatgtatgtagtttactaagtcagaacagttgacattttccccctctgcaatagtgaaagtcgaaagctggtcctaaaacctttcggtggttgtggttgggaatacggtcagtgcctcatgcagcgtcaccttcactcgggtgtgtagctgcaacttgcacagcttctttcccagagaagtgggaggagagaagcttcctttgtggggcagttggaggcattggatgaggggtttgtgacagcctggagctgaggaaggaacgcctgagtcccctggagcaggtgaggcccctcccgagagggcagaggctgcttcctgtcttgtcaaggacataaaaagatgatcgtctaattattaaagtaatctgtatatatttagataatagagcatgaagtacaaaataaaacctttgaatgctttcatcccatgggggtgtgatggcccctgtctccctaccgggtggcgccaactctgtccatggtctccccgcggggcggcaccaactctgtccatggctcagttgctgcactcaattctttgcaccacggaccaggagatgggcctggtgcgccattgtcttcttccaaaacgagatgacctggtgcgagagtgtcttttctttttctttcttttttttttttaattgagatggagtctcactttgtctcccaggctggagtgcagtggcacgatctcggctcactgcaagctctgcctcccggtttcacaccattctcctgcctcagcctcccgagtagctgggactacaggtgcccgccaccatgctcagctaatttttttttgtattttcagtagagatggggtttcactgtgttagccaggatggtctccatctcctgacctcatgatccgcccacctcggcctcccaaagtgctgagattacaggtgtgagccaccgcgcctggcccgagtgtgtcttttttttttttttttaatttttttagtatttattgatcattcttgggtgtttctcagagagggggatttggcagggtcataggacaatagtggagggaaggtcgcagataaacatgtgaacaaaggtctctggttttcctaggcagaggaccctgcggccttccgcagtgtttttgtccctgggtacttgagatcagggagtggtgatgactcttaaggagcatgctgccttcaagcatctgtttaacaaagcacatcttgcaccgcccttaatccatttacccctgagtggacacagcacatgtttcagagagcacggagttgggggtaaggttatagattaacagcatcccaaggcagaagaatttttcttagtacagaacaaaatcgagtctcctatgtctacttctttctacacagacacagtaacaaactgatgtctctttcttttccccacatttcccccttttctattcgacaaaaccgccatcgtcatcatggcccgttctcaatgagctgttgggtacacctcccagacggggtggcagccgggcagaggggctcctcacttcccagacttggcggccgggcagaggcaccccccacctcccagacggagcggcggccgggcgggggctgccccccacccgagtgtgtctacctgtcgtttgtggtgggacatttagactgctgccctcccaatttggtattaaaactcaatattgcaaacagtccacgtaaaattgtgtaccgttctgactgatttctagggatgagtttctacaagtggaacgcacgttttcagggtctgaatgcaattactggagaggctgaacaagttggaagttctttccccgtcttttccagttgggtcaaaccttaagaatgtttgccaacttcgttcaatgggaaatagtatctgcttttattcttacttttcttagcagcagtactgagggttgcgtagatttttgccgagcttggctctgtggagtgcggtgcctgtgggccaggaggcaccatctgagtacttctccctccgtggggtcctccgggaaaagagcgcgctggctcgggatcccgggcggactcccggcgagacaccgcagcgccacctagtgccgggatgagcaggtgcttttcggccgagccagtttccgtgcagaacacctgagcctgggatccaggagaggtggtgcctgggggcgtcggtgccgtggagcctttctcccccttggtctcgcacactctcgcacactgattctcaagagtgtttgagaatggcggatgccgtcagtggaagagctcttacaggtgcttggccggttccctcgacacctcccagactcaccgcaggttctgagtttcctgtacttctcagacccctttttggtgaggattgttcaggtaaggccagggctgcgaggggtcctgtgccagcatttgtctgcagtacaggttcgttttctgctctccagggaggagcagcctgctctagcccactttgctctcaggattgaatgcttctccctgtatcactggcggctctacagctgcacccgtctcccttgattaactgagcttgccaacatccacagcgctgtaggtggtgcttggtgttacagtgttgctagaacatgcagattgagtgctgccttagaaacccacaggaaggggaacatcacactctggggactgttgtggggtggggggaggggggagggatagcattgggagatatacctaatgctagatgacgagttagtgggtgcagcacaccagcatggcacatgtatacgtatgtaactaacttgcacaatgtgcacatgtaccctaaaacttaaagtataataataaaaaaattaaaaaaaaacccctttaatagatatgcctttcgccaggcacggtggctcatgcctgtaatcccagcactttgggaggctgaggcgggtggatcacctgaggtcaggagttcaagaccagcctggccaacatggtgaaaccctgtctccactaaaaatacaaaaaaattagctgggcatggtggtgcgtgcctctaattccagatacttgggaagctgaggcaggacaatcgcttgagcccaggaggcagaggttgcagtgagcagagatcgcaccattgcactccagcctgggcaacagagcaagactccatctcaaaaaaaaaagaggtacgctgtatgcagaaaagttggaaatcttggcgtggcgtggtggcacgcacctgtggtcccagctattccgaaggctgggtgggaggattgcttgagcccagaaggttgaggtttcagtgagctgtgattgcgccactgcattccagcctgcacaacagagcaagaccctgtctcaaaaaaaagttgaaaatcttgaaacatagaagttggaaaaagatatataggtaattcttatacacagtgcgtgtaccgtgtttatcttctttgcaccgttatgacttttaatgtgcacagcatgatcttaacaagtcagagtcagcactgtgctttttcacctgatttcatgtaactgctgatgaatggctccgtcgtgttctgctgtgtttcgatactgcactcagctctgtcacttcctgcctcttgtgagcagtcacggacgcctgggtttggttacagacccgttctcgtgtcaggattgtttcgtgaggatgggcccttagagatggacttctgggttccaggacacgagagtggtgttggggtctgcacacctggtggctctcagctgctctctgagcagtgctttggtggccgaggcagccccaggaacaccccacccccaaattggattaaacatggtgtcgctgattgcaggtatttaattggcatcacgctgattgccctcaccttaggtgttacatactccgcttcgtgacctgactctgcgtgtctgtgggctccttggggccttttcttccccacgagtgtgagtttcctccggtgaagggcgatgggtattgccccaggtggttgttggccttttcctttttttttggaccaaagttttaattttaatgtcaaaccgtttttttctcctttatttagttatttttacttttaagcctgcagtcttattaagagatttaacaagtagtcatttatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcggccccgaatgccaggctgcactgatattattggatacaagacaaaggggcagtgtaaggaatgtgagccatctccaacggtaggtaaggtctcgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgcgggcgagcctgactgatgtcaggccctccacaggaggtggaggagtagagtcttctctaaactcccccggggaaagggagactctctttcccggtccgctaagtagcgggtgtttttccttgacactaacgctaccgctagaccacggtccgcttgtcaacaggcgtcttcccagacgctggcgttaccgctagaccaaggagccctctggtggccctgtctgggcataacagaaggctcgcactcttgtcttctggtcacacctcactatgtcccctcagctcctatctctgtatggcctggcttttcctaggttatgattatagagcgaggattattataatattggaataaagaataattgctaccaactaatgattaatgatatatataatcatatctaagatctgtatctggtataactattcttgttttatattttattatattggaacagctcgtgtccttggtctcttgcctcggcacctgggtggcttgccgcccacagtattccgcttttccattcatttctaatgctctgtgggaactctgtgcgttttaaagggaacacggtttgtcaccaccttaatgctgcttccttctgcgatgaagttaactgccctgggccccttttgcagatccgctaaagttaactctcctggggaggacacatgagtttcttttttctttccttttcttttcgagacagggtctcactctgttgcccaggcgcgagtgcagtggcgtgatcacagtttactgcaacctccatctcctaggctcaagcaatcctcccaccttagcctccccagtagctgggactgcaggcgcatgccacgacacccagccaatttctttttctttttttttttttgagacggagctttgctcttgttgcccaggctggagtgcagtggcgtgattttggctctactggagtgcaatggcgtgatctcagctccactgaacctctgcctccctggttcaagtgattatcctgcctcagcctcctgagtagctaggattacaggtgtgcgccagcacccctggctaatttttgtatttttagtagagacggggtttcaccatagtggccagggtggtctcaaactcctgacctcaggtgatccacccgtcttgacctcccaaagtgttgggattacaggcatgagccactgcgcccggccatgcctggctaatttttgtattattttctagagatggggtttatttatttatttatttatttatttatttttacggggtcttgctctgttgctaggctggagtgcaatggtgagatctcggctcactgcaacctccgcctcctgagttcaagtgattctcatgcctcagcctcccgagtagctgggattacaggaatgcgccaccatgcccagctaattttttaatatttttagtagagatggggtgcaagacaggctgttctcgaacttctgacgtcgtgattcacctgccttggcctcccaaagtgctgggattacgggcttgagccactgcgcctggccaagatgggggtcttaccatgtttaccaggctggtcttgaactcctgaactcaagctattcacccacctccgcctcccaaattgctgggattacaggggtgagccactgtgcccagccaaatgattctttactttctggaaatagggacttctttccccattgttcatgctgagcccctccctaagcatgctccacagggacagtggcggaggggagaggtccttgctgttacgagcagttggcaggtgccagccgtcctgtcagctgggcagcgcttctgttttgtgagggccatgaccgagtaggatggcacgtgcgtggctgtctcctgtgtgttaagtgccctgagagggcttgtccccacggaagcatggagccggctctcgcgcaggccaactagatggatgtgctggaacaagggccgggaaggtgggatggccggagttgaagttgcagtggagatgacgtgggggccggagggaggttgggcgtcatagcctggcagctccagcttccacgtctcaccttgcctggggtctccacgtagctgtctcgtgggcgtcgcgtggggcactcccccacgtggactcttccgcctcctggccctcccaagtgtcccttccgggaggtggccttgtggctgttgagggagcgcctggtgcctccctcctggcatcactgccgtctccttccccccaccccataaaggtgtggctaggatgccagtcagacctgccggcatggcctaaagaggaggtgggcaggcttggccagtactggtcctgtccccagcacctctcccactcggctgctctgcttcgaccatgttgcctttgcagttcgcgagttcccttggctcccttctgccctgggccctggctctcctgcttccctgggcagcagcactttcctcccaggttttgcagcccccctcgttgagctccgtggcttccgtcctctctctaacgaggccatgccctcccgtttccttcgtaacttttctttgcactgtggaagtccccagctgtttgtcgtttctctccagagtgtcagctgtgggagggaagggccttgtctgttctccgtgtggcagtgccagtctcgatcatggaggcaagctgggggcctggcctatgaactcctggtggagaaatcaggaggatctgggctaattagctgggcatggtggcgtgcgcttgtagtcccagctactcgagaggctgaggcaggagaattgcttgaacctgggaggcagaggttgcagtgagtcaagatcacaccactgcattccagcctgggtgacagcacaagactccatctcaaaaaaaaggaagacttgggctttttttttttttttttgagacagagtcttgttctgtctctcaggctggagtgcagtggcacaatcttggctcactgcaacctccgcctcccgggttcacgcgattctctggccttagcctcctgagtagctgggattacaggcgcacagcaccacacccggctaattttttgtgtatttttaatagcgacagggtttcactatgttggccagactggtctcgaactcctgacctcgtgatccgccctcctcgtcctccaaagtgctgggattacaggcatgagccactgcgcccggccagatttgggcttttggtttgggagctctgtgtgctcaaggtgtcctgcgctgaggccgggctgcaagaggggtggggagtgtgagcactgcctggaacacgaggccgagtccaacagggaagactttcatggggctacacgagcagctggctgtggaaacaggcctgtgcacaagacgcatggcaggtgtgggggagggaggtcccaggggctggggcccagctgccggggccaggccttgcacgtgggcacggtgtcctgaggtcaagggatgcagagttgggtccagggaggagggaggggctgagaagtgggcaggggctccctggcggtgatggggacaggtaaaactgggggggtggagggggcaggcggggggggatgggcagtaggcctgcgacctgagaggttgtggtggggaaccggctgctgagggccctggtcagggcagcgacttggtttctagggttggagagaggaggaactagctggaggaggacaggactcagtacagagctggcatcttggtgtaagggtgcgtgaggtgggagggcctggggaggtgggtgtgtgtggggtgggctggtgaggcgtgggcgaggtctcagtgctgaggccttggttgagctgtatccttttggcagatttatcacacgtcctgatgtcaagcaaagcaagatggctgagttcctggactggagcctgtgcaatctggcccgttcctccttccagaccatgcagggggtcatcaccatggatgggacgctgcaggccctggtaagtgctgcccgcaggggctgtggagatcgcagggaaatggcgccttacatggggaccacggaatgatgttacctgtgattccatcttgacgtaattggaaccccgtgggattgatttaaccgggccagggtcttgggcagtttccttttccctctgctttgggtcctgcctcaggcagggctggtttctgcgctggtgctggtggatgggcttggagccccacctgttgccagcagagggcagtggtgccacgcagccggggctccccagggtaggtttctctgcatctgggctgcttagttcctgtttaagtgcagagactgaacgagctctaataaaacaaggtgggtgagttgaaatttgattctgttcctttgcactgggctcgggttggatgttcctgactgcttcgttgggacacagaccctggcctctgcctgcaggtgcctggttagtgccctggctgcagccctttgccagccctttccctgccctttcgctctgattgtctcttgtgttaccttttcttgtgctaacgaggaggaaaggtcaagtctcagaagagggcaaagcctcttttgggtcagcgtcctggaggctgcagctccctggtcagccttctggagggggagccggcagccggctgtggcctttggcgtggtgggttcagcgccttcttctctctttaattacagcgggtgaggctttgagagcacttctcatccttgtctcacgctgtggagcctgtggtccctctgaggagcggggcactttgttcttgtttaaaaaatatattttatagagacagggtcttgctatgtaggtcagggtggtcttaaactcctggcctcaagtgatcctcctgcctttgtgatgatcccaaagtgctgggattacaggcttgagccgccgcgcctggaaggacactttggagcgcgttttaggggagatgatgagtgccacctcgccacggcgtcctcctgtccgtggcgtcgtcctcctgtccgcagcatcgtcttcctatccgcggcattgtcttcctatccgcggcgttgtcttcctgtctgtggcgtcgtcctgtctgcggtggcgtcgtcctgtctgcggtggcgtcctcctgtccgcagaggcgtcctcatgtcctcagtgttgtcttcctgtccatggcgttgtcttcctgtctgcggtgtcgtcttcctgtccatggcggcctcctgtccgcggtgccctcctgtccatggtggcctcctgtccgctgtgccctcctgtccgcggcgtcgtcttcctgtctgtggtatcatcttcctgcccgcggttttgtcctggccgtggcaggttctgccagggagcgggaggctgtcagctgggtggaggggggctgtgggagtgatagcctggggtgggggcatacgtttcttgagggggaattgggaagtgtcctcctcaatgtctgctgcttcccggtcatgctgccgtggtcttcaggagggcagcctttgaaatgaggaaaaggtttcagacgtgtgagagaaaactgcagacgtgtttcctggagcctgtgctctgcccaggtgatgtctgttttcttcaggcgtcccctcaacctccacataaatgtgacagattcagcagttttcaaaaatcaagatataattcacataccacaagtaatttatccttctaaggtaaacaattctgtagttttctgtgcggtcatcaccattatctaacttcaggacactgtcatcatcgtgagagaaaccttgattgcaccgagcagtccgtccctcaccttccccagcccctgcagccgtggatccatgtgctgtccctgtggacttgctggttgcggacatctcacctcaccagagtcgtacacgacacagccttttgcgtctggccttcactgagcccgatgtgtccaaggttcatctgcgctgtggtgttgtcagtgcctcgttccctttatggccgaatcataagccaacgtgtgggtattttccatatgccagcgtgtgggtattttccatatgccagtgtgtgggtattttctgctcttacaaattacgctgtgaagaactttcatgtgcaagtttttgtttaaacttaatgctttcaggccgggcgcggtggctcatgcctataatcccagcactttgggaggccgaggcaggcagattacttgaggtcgggagttcgagaccagcctggtcaacgtggtgaaaccccatctctactaaaaatgcaaaaaatagccaggcatagtggcgtgggcctgtaatcccagctactccggaggctgaggcaggagaattgcttgaacctgggaggcggaggttgagtgagccgagatcatgccactgcaccccagcctaggtgacagagcaagactctgccagaaaaaaaaaacagaaaaaacaaacccaacttaatactttcagtacccttgggtacacaacactagtttttaataaaattttaaacaaaatttggaatgttttcatctttctggagtctttctaaaaagatttttctggtggcatacctgtcgtactgatgaaatagaggacctcctcatgccaggcatttttgggcattgcaggtacagatgtgctgtctgtgtccccaggtgcccctcgttccggccgtgctggggcagcatcctcaatgcctaaagaggattcattgctatcgtggaggtcagggcaggctgaggctggccttgaagggtacgggggtggaggggtagggcagggaggactcaggtctcggacgtacccactgtgccattggtccatggatcctcagggaatgtgcgttttatgttttaggcaattctggtaaaggtggtggatttagttgcaattggattcttcattttttgccttgggtctcactgaggaaacatgaagaaggggtagatggcagtggccagggtgggggtcctgggaattctggtagcttcaccttaatgtttgtgatgctgggtgtacagacagcctcccacatgaccaaggacacgctcttaggtccctaagaccccagaagaatgggccgctactgccaagaagtatgacatgcgtgtggaagaccatgagccttacccggctggtggcatggggtgtggcaactgccgcagctccccgaaccattgcagtgggaaaggggtacgtgctgtgactaagaccactggacccgacccatcgcagcgacagggggtccatgctgtgtgactgagaccactggaccccacccatcgcagcgggaggggggtccatgctgtgtgactgggaccactggatcccacccatcgcagcgacagggggtccatgctgtgtgactgagaccactggaccccacccatcgcagcgggaggggggtccatgctgtgtgactgggaccactggaccccacccatcgcagcgggaggggggtccatgctgtgtgactgggaccactggatcccacccatcgcagcgacagggggtccatgctgtgtgactgagaccactggatcccacccatcgcagcgggaggggggtccatgctgtgtgactgggaccactggacccgacccatcgcagcgggaggggggtccatgctgtgtgactgggaccactggatcccacccatcgcagcgggaggggggtccatgctgtgtgactgggaccactggacccgacccatcgcagcgggaggggggtccatgctgtgtgactgggaccactggacccgacccatcgcagcgggaggggggtccatgctgtgtgactgggaccactggatcccacccatcgcagcgggaggggcgtccatgctgtgtgactgggaccactggacccgacccatcgcagcgggaggggggtccatgctgtgtgactgggaccactggacccgacccatcgcagcgggaggggggtccatgctgtgtgactgggaccactggatcccacccatcgcagcgggaggggggtccatgatgtgtgactgggaccactggatcccgtccatcgcagcgggaggggggtccatgctgtgtgactgggaccactggatcccgcccatcgcagcgggaggggggtccatgctgtgtgactgggaccactggacccgacccatcgcagcgggaggggggtccatgctgtgtgactgggaccactggacccgacccatcgcagtgggagggggtccatgctgtgactgggaccacctggcctgaggttggactggtgaaatgacaatgttggcacctacatgtgtgtcaggatccatgtggatatgtcccgcacacctgcttcttggaatattgtgtaagcagctcttcagcttcacggccttcatgatcgtgttctgggtggggaagaattaaccagcctaccagcccgtggggccaaagcagtgtccttataatcatctgcacctggaaccaggtggcgatcccaccgtagaacctgtggctcacaggatctgaggtggcttcgagggcttctctgccctctaggattccctcatccttagaaatttaaccttaatgaaatccctaataaaactcagtgctgtgggggaaaaacatctcaggtcaggggagcaaatgggaggtctaacaggatgtgaccagagctggttgtctccaatggctctgccccgagtgtggtgcctctgcaggggaggccgttagccctgccccgagtgtgggtgctgctttgggaggggaggcaaatttgatctctgtccggtctcttaacgggcttctaggggtctcctgcagctctcgtcagcctggcctgggagcctcccctcctctgccgtccccaccccatgctgttgggtcagcaggatatcccagccttggggctggagccagctgtggctgcccagggacttgcaggcaggtgaggcgtgccaccttctggccaggctggctgtgggagaggcagcctcctggtgaggggctgtgggccactgcgttcaggctgccttggagggctccacggtgtcccctgggtgcagggctccgagtccttctcggcttgggagggtcttgtggccacatgtgtctagttctgcagtttctttgttgtgggttcggttctttactttttttttttttttttttgatgatcttgttggttttctctagattgttcccaagttttctgttcttccatcccaagtgggagacacgtgttgcacagcctgcatttggaatacccagagggtgggtgggcgggacggctcgctgccccattcccctcctagctgctgggacaggtgggaattcctgtagcaaagtcaaaccagccaggagtggggaagtgctttttattttgacatctccaagttccacgttgaggtggagagacattcgtttttccccttcctcccgaggtgtaaaacggtcttctcaaaggcttaggagagccgagccctgtgccaccccccggcatatgctggcaaagagtgaggcgtgctgtcctgccgtttagggcagagcacccaggcggtttggcagcagcacctcagaactattcagagatttgccctcagcaagagtgagcaattgtctgacgcagccggctgaaatccctgggaagggaatgaatgaaactgccgtgaagcaacgcctggcggggccgggcttctggcagctcctggggccagcacgtcccttccagagcgtctgaagccctgggcggctgctggagcatctcgagtctttccagagtcatgtgtgttgtttccttctgtctcttggaagggtccgtttggtctgatccaggttgcctcagcaggaggaagtcgtgctgggtgctgagcgggtgggaggtttcaccttgggcttggcagagctgcaggcagaggccgggcgcctgctgtacatgatgaaacttgcaggtggattctgcttagggtttcatctgtttcctttgatgcacttggcttcattgtcatccacctgttcattactgtgggcgaaacaggtgaactctcaacaagtaccatcgaaaccaggatttgatcttcatttccctcgaagcgtagttcccttgcagtgagggtttttaactcctgtgggagggaagcaagtgtttggcaatgtaatttccctggaaggcccctgtacttcagctttaaaaacacgctttggtttagtcccaatttaagcattaagattaatgcaaattgaggaaattcaaggaaggagaaaaacacattaaaaatggaaaatgggctgggcacagtggctcatgccggtaatcccagcgctttgggaggccgaggcaggtggatcacttgaggccaggagtttgataccagcctggccaacatggtgaaaccctgtctctactaaaaatacaaaaaattagttgggcatggtggtgcgcgcctgtaatcccagctacttgggaggctgaggcaggaaaatcgcttgaacccgggaggtggaggttgcagtgagccgacatggcgccactgcattccagcctgggcaacagagcaagactccatctaaaaaaaaatttacaaaaaggaaaatggctgtcatttcatgtgtgactctgcttgctgattgatagttgtgctctcttggtttctagtgctctgattggaagattgtcgactgtgtggagtgggtttctccctgtgtgttctcacaatggctgggaggcggcggcggggctgggggactcggactgcgagacggggctgttgactatgaaagtggtaataggatgctcttccccttatcggctgttaggctcgagtctcccctttgcagtgcggtttctttttatttttatcattgacaaaagcacaactcttgttaaaggataaaatagtcacacacaacagcattaaaaaccaagaaagccaaagaacgctggcactgtcagcctcactcccagctcccgctcggcccttgtgaagagaggtgctgaagccactctgcttttttatagttaataaaagcagccaggtccccaagtaggagtggttgtggccaagagtgtgtgggccgggaaccagggcttgagctgctgtgagctgtgcccaggccctttgctgactccgtctctcctgtgacctgaggccagggtgagcaccagcgcccgccccacctgggagggaagcagcagacctctcaccgcagaggctggtgtgaggctaattagcacagtcagtctttgaagatgaaagaagacagctgattatctaaaacatttcacatttaggctttgatttctcttcagatttggggaacagcaccctactgtttcatttagggttcagtgtggccagaggaagatgacccacgtggtcctttttagttgtagtgctctcttggggcaaggttttggatggagaaaataggacaagagcagtttgaatgtgggtactttccagagatcatgctcctgtagcatttgggtgaaacgaggtaccccaggccacgctggttcggtctcctcgtggcgttaaggaaagacctggagcagccagctcctaacactcatttcccatcactcagcattttatgtggggcgggcacagtgccgtgagtcttacagaaacctgcatggtgagccgcacgcctttgagtccccatcagccctggcccatccctgctgaggtggcgcgacctgctcacagacgtgtgctcacaggcagcccgtcgcggggtcatgtgctagacggggagggggcttggcgggtcaccagcctcaccccgctcagttcttagatgaggaagagacaggcagagagctgggctgggctgctgctgagtgggctagagctgggtctcagtggcccctgccccagtcgtcctgacctgtggcccctgtgcaggttggggtgcccctgccctctcccctgccccgccctcacctggctcacagacccgtgatgcctcactgcccacgcagtcaccttagaggcaccttccctctaaggcagatgtccctcaggctttggtcctggctgttgatatctcagctctgattcacccttgacctttattacctgatttctgtccttggttctcgagccctccttctgtggacccgttgggtacacgtgtgacacttcagaacccgcaagtcccaggtcacacctgttgtaccatcactttcccctcctggcctgtttacccgggagcccagcaacaaatgggagcttctgtgctgctgtccgtgcatacggcccaggagccgggctcatccccgagacgccgtgttccctcccgctgtccgctcacacctgcctgtgtggacgtggctctgacatgtctccttcctggttcattgctcatctgttctcatgtggctgcgccgccaccctgtcctgggggtccttgtcccagcacgtggctctgtgcttcacgtcatcctgagtctgtcccgctctgccgcctggtccaggtgggagccatttccttctgtgaagtgttccctctggaggccctgggctccccgactaccctcccgcctctcctgtggctgtcggctgcagtaaaggtgctggtggagggtgtgagccatccattcatagagtgccagactctgtcccatgctgcctctgtgcccttgatcctggcagcacacctgctgtcctgtggcctgcgtaaagggtggcctcggaagcctgtggcctgggtaaagcgtggcctcggaagcttgtggcctgggtagtgggtggcctcatcttggcctcggaagcaggagggctcaggctgtggcccacgcctggggttccccatccccccgtgtgtcctggtgtctttgcttggctcgccggcctccatgggctccccaggtggcaggtggctctcagccatgctctccgtcctcatgcttgtttctgccctggcagagctgctcagtggccagcccgtgggacccctgtgcaccctgccgcccccagcatatgtcagcagcgccgtccgggggagatgtggcatcagcacagccttgtccttgtctctgcccgttcttccttccttgcctctatgtgtctgcttttttctcttccacatggtgtccacagtggataaccacatccactggcctcctggttggtggatcctcctcctgctgggctcagagctgtgccacccccacctgcactgcagagaagctcagacccctctctgacctcagacgctggagcctgagccccctgcttcccaggccaatgccccttcaggtccctgcaaagccactgctctttgtggtctccctgccgccgttgccctccctttgccgctgagcccgtgggctgcttggtggcttgggagctgcatacaattctattttgtctggtttgttttcaggctttctgtggcaggaattgtgtctcttgcatctttttttttttttttttttagacggagtctcgctctgttgccctggctggagtgcagtggcgcgatctcggctcactgcaagctccgcctcccgggttcacgccattctcctggctcagcctcctgagtagctgggactacaggcaccctccaccacgcctggctaatttttttgtattttagtagagatggggtttcaccgtgttagccaggatggtctcgatctcctgacctcgtgatctgcctgcctcggcctcccaaagtgctgggattacaggcgtgaaccactgtgcccggccatggatcattaacctcttttctagcatcttacctctgtggtggttcacttttgcgagcttttgctgggccttggaaggtgcgtgggctcgctgctcctctcttctgtgggaactgttgcctttgggcagggggcacaccccagaggtggtcacacacacctgaacgggagcacagtcataagtccctgtcatgcaaagatgggctgtgcagaatgagctcggaatagcagccagaaggctcagtgatgggggagttgtttaagctggaatactgtaatgctgctggctgtttatggctgtgaggtcactacgtgggctgctgagaacattttaaaatgctgagtgagtcatgaaacagtcatgcgtcccctaacaatgagggtagtcctgagaactgcgtcgttgggcagtgtcgtcgtgtgaacaccgtagcgtgcacttaaacatagatggtgtggcctgctgctcccaggccaggtggtgcggcctgctgcactcccaggccaggtggtgtggcccgctgctcccaggctgcaaacctgtacagcacctgactgtgctgaatactgcagggaactgtaacacagtggtgtttgcacatctaagcatagaaaaggtacagtaaaaatatatcatcagctgggcacggtggatcacgcctgtaatcccagcactttgggaggccgaggcgggtggatcacgaggtcaagagatcgagaccatcctggctaaaatggtgaaaccccatctctactaaaaatacaaaaattagccgggcgtggtggcgggcgcctgtagtcccagcgactcgggaagccgaggcaggagaatcgctcgaacccaggaggcagaggttgcagtgagccgagattgtgtcactgcattccagcctgggtgacagagcgagactccgtctccaaaaaaaaaaaaaaaattatatgtatatacacacgtgtatacatgtgtgcacacacacacacacatatatgtgtatatatatgtatatataaaatccttttatgggctcactatcaatatgtggttcctcattgaccagaatgttctatgatgtaggactctagtgcgatacactgtcatgaacagattgataaattaggtgaaggatgatgcctgtgaatgacagacgtaggaagccacaatcattttgtgttttccacactctctttgagagctgtgttgccttggtttatggatgaggacatggacccaggtcaggggctgccaggtcggtgctggggtgtggagctgggccttgcatggcccccacctgtgaaggtaattagtgtttaccttacagtccaaagtttggtgaaaaataacacttcgttctggaaagataaaagctagatgtgattatttcgatcattgaagcatttttgtgtgaaattacctttttttttggcgtcagtggcatgatctcagctcactgcaacctccacctcccgggctgaagtcatcctcccccctcagcctcctgagtagctgggattacaggtggacgccaccacacctggctaatttttgtacttttagtagagatgaggtcttgccatgttgtccgggctggtctgggactcttaggctcaagtaaccctcctgccttggcctcccaaagcgctcggattctaggtgtgagccactacacccagcctgaaattagttttcattttgatatttgttttcttaaaattctttataatttgtcagaaatttattttgtcagaaacagtatattttttcactctggggctctgattctaatcagtcatttaccaatccagcaatgaaagttttcacttccgtcaatggcttttttcctctgaatgtgtggtggtcctgaggggagtgcattttgctcgctcctgggggaggcagtggtctggcctgtccccaccagtgccccctaggccccgccttgaggacaagctctcttctgtttctgagcgctctcccgtcctgtctagggcaactgctgctctttctaggggtggtagtggggctctttaagatgtccctcgctttgatttttgcaggccagcaaatgcactggacgttgtggtttttctggcctccagtagtggtgtggtgggaaggttcttttcctgccctgctgctgaggggagcctcgagcgtaccagagttcctcagtgaagcctttgcacgtcctgcagggtgcagcccagcatgggtttcactgccctccaggaaaggcctggccctggtgggctcgctgcagcacaggcacggacctggggctgtgctctcaaggcattccagcctggaaagggttgttttggtgttaaagatcctcttccgtgcctgtcctgtggcccctctgtgtggcatgcccaagagtggctttgaacatggctgccctccgtgtgctgagcctgcgggggcacggctaccctccgtgtgctgagcctgcgggggcacggatgcgattggttgcttcccaagataccatttcttggtgtcggagcaggactcgggatggcagaaaggggaacagactcgctctcctcatctgcagagtcggcatggttatgtggggccacagggtgacccgctggcctggagctagcgtggtctcagccatctgcctcagtgccggccggcactcacagcttctcagaagcctgtgttaccagccagagccaagcctgaactggtgtggtgtgggggcccttctcccagggcctcgggtggagttgcttttcttggcctagatttggcagtgcctgaagggagcctcaaaccagcatctcctgcttggcagcgggtgagcttgctcccgagtagctcgacagcctgtgatttactgggcttggagaacatgccccaggggggggaagctggctcgcacgttgcagagaagccagcttgggtgggtagccatcgaaaggtggggcgggttaggatgattgctgagaaactccttttgtttgcagcttgtgctgtgctggtttctagaacaacaaaaacagacctgcagtcattcctcatttaccatgcagggctgttttcctctaatccctggtgtcatcacctctgtctagtgtatgcttttcagcaggtggttttaatttggttcccattatgcttccatgaaagtgggctgtgccccccattttatggcctagcttatgagcactcaagaccattgatgactagagtgcgctctctctggccgcgtcctcctgctgacaggtaccccatcccaccgccacgctgagcactggccactgcacactgcacactttctctggtgaagatggccttacttttcagtgaaataaatggaaacaaagccctgtcttcattgactcgttccttccctgtcgtctcttttgccctcctgcacccatgcctgggaaagtggataacttttggggcttttctctgtgtgtgctgaatgcccaggaggctgcctgtgtaattcagctggaaactgtccccagggtagagagaagtgtgaggagaaaaagacccttcgccctgtaaatgtgtggggttctggtttctcccttactgcagatggtggcgggccctggccttggtgctgtctcctgtgtgtagctggggacggtggaagctgggctgggcctttccaggtgtggggcatccaggccagttacaagagatgatgcttgctttcccgagaactcatcaccacttgtatcttagtctgctgtagagaatgttgtactacacttcataggaattgagtaactaaacaacgttcatgtgtgagggcactctaggaatttcacagtgtcttggattctttttatttagtgagagaaaccagacgacgtgttagcccgttgccaagtaagactgggggacacgtcagcctgttgccgagagagaccaggggacatgttagcccgttgctgagagagaccgggggacacgatagcctgttgctgagagagaccggggaacacggtagcctgttgctgagagaggtcatttcccggatctttgtcctgcgtccgcccacagctgcacagctgctcttctggtttaggttctggcctttcccactggggttttccagcagcctctgtagcggtcttcgttgttgagcacttcactgttcatccccaggttctccatccagctgctgttggaatctggtcatgtggccatggctgcaggtgatacggtggtgctctttgcctgtaggatgagatttcagccgctcgcaggttcatttgttgtggaacaacgtactccacagctggtggcatcagtgacagccgcactcttgcgtggatcgattctgtggcctcgcagggtggggtgcagggggccgtttgttactgccctttgatgcctgggcctctgccgagaagaccacgtggcaggtgccttgaagggctgggtgcggcaggggcccttgactgaagctggctcttcctgcatggcagccggcttcccggagggagtgtctcaaggggaggtgtctggagaggccctgaaagaggccgccaggcttctgacctgggattgggggtcactggcatcactcctgcctgcctctgttggttgtggcagttggaagcctaccaaggtggtgggtgagggacccttgattgtccgtctggcaaactctgttccccactgagctggccagccggctgcagtgacagcttctctgtgaagtgtcttgtcttcttatcccccaggcgcggtccggcttctcgttgcacactggtgggcttcaggccgtcagcccacctcccagggaatttgagtgtgtgcttggccctgcgactgcccccgaaccccgcgtcccgttgcggggagctcgcctgtgccccacggtttctgctcagcaagtgttggctctgtaaaccgatgacttagggttaaaacacatattaaattagatacatctggactggtgtgaaataatttaactttcgattttatatttcacacaaactaaagatggggaagagttcttaaagttaaatgagaacttgttttgggcaaacaaggatcatctccattcacttggtagggaacgtgttactatccatttcgctaaagagaaaggggctaagtctctgatcaccttggtgaatgtgttattctgagtggctcagggaggtgggtgctgccactgccccattttacagacagaggaacaggagcgcagagaccctgctctgctccacaggcgtgactggtggtctgtctggctgtctccttcctgttttgatcgtaggtgtgggatctgcaccacaggtgtgactggtggtctgtgtgcctttgctgcttctccactcagcgcttaggagagccccccagcgggctccatggagagagtctaagttccctctccttttaagaagatgtttctattctacacttaagtaagagatcaggcagtttacagggttcataatgcaaataaaagacaccagtatttagtgaaagcctcttcaccttgtctgagcatctcctgatgggcggcacctgcttcttcatttttccgtgtggtgggcgacagcaggacaggggtggcgtggtgtgcggtgcagatagtctgagacagatgcagttctcaccttgactgtgaaattctgttttctgaaggaaaggaaattcattcgcgttttcttagaagggctcagttctaggattcttcgattatgaggcttggatatttatgtgaatcatcgcatttgtcctccagactttaaagcagaaggtaaaacctcaggttgagaattcaggagggctagaaccagtgtttgagagaaaatctgatattcctgtttggtctgatggactccaggtgatgacgtccgtgtgtgcgcatcgtggggaccgggctgccaggtgtgtgtgtgagacacgggctgagctggtcacccttctcatttgttggtgaagcatgaatgcagatggaggcctttgtgtgaggtggtttggcctgtaacttttatcctttgtaactttatttatacgcagataatttttaaaaacctactgagatatcttctttttccaggctagtagtgccctgaacttaaacctgggcacgttttgtgatgccattgatgagggaggggtggagaggctgcagtctccatgaggggactggacttatcattgcatccctattttcagatgaatttttgggagatgatttcactagtctcttataattactttatcatgtacagaaactgttttctttattattaggtggtgagtgtttagaataaaaattctgaaagatgtgatgaattgttttcacaatttgtgtgtatgttttaaacttctatttgtatttgtaacattaaaaatctttttttttttttttaggcacaaatatttaaacatggaaaacgtgaagactgtttgccctatggtaaggtttatttttaagagacgatatctttgtgatgtgagtttgctcatatacaatcaagtgtctttccttaacattttattcatagatataggaactgtacattggtatgtttggacactatcgttcttttttttgttgtgggttttagtaactgaacttttttttttttttttttttttttttttttttgagactgagtctccctctgttgcccaggctggattgcagtggcacaatcttggctcactgcagcctccgcgtcctgggttcaagcaattcttctgcctcagcctcccgagtagctgggactacaggtgcctgccaccatgcccagctaatttttgtatttttttttttttgagatggattttctctctgtcgcccaggctggagtgcagtggcactatctcagctcactgcaaactccgcctcctggattcacgccattctcctgcatcaacctcccgagtagctgggactacaggtgcctgccacaatgcccagctaattttttgtatttttagtagagatggggtttcaccgtgttagccaggatggtctcgatctcctgaccttgagatccacctgcctcggcttcccaaagtgctgggattacaggtgtgagccaccgtgcccggcctaatttttgtatttttaatagagatggggtttcaccatgttggccaggctagtcttgaactgctgacctagtgatctgcctgcctcggcctcccaaagtgctgggattacaggcgtaataactggactttttgtcactttcctagtcctttgataaagagggattgctgccaggggtctcgtgagggaggtctgggcaaagcccgtgtcatgatctgaggttggacctggcttcttggggcccaggagcagccatgttcctctgatagccacagccaccacctcttttgccttcttcctaattctcttaatttattctttttgagactgcatcttactgtgtcgcccaggctggaatacatgacacagctcactgcagcttcgacctcctgggctcaagccatcctcccacctcagccccctgagtggctgggactacaggcgagctctaccacgcccggctaatttttttagcagtggggtcttgctgtgctgtccaggctggtcttgaactcctgggctcaagtgatctgccctgccttggcctcccaaagtgctgggcttaaaggtatgagccaccacgcctggctcaattctcttaattttagattgagcctcaatttctgaaaataagggcagtgtttttctccacgcagaggtttaccatctggaaaaagagaaacttcttagagcctttgtgtgttttagaagctatccggactgggcgttgtggctcacgcctgtaatcccagcgctttgggaggctgaggcgggtggatcacgaggtcaggagatcgagaccagcctggccaacatagtgaaaccccatctctactaaaaatacaaaaattagctgggcatggtggcacatgcctgtaatcccagctactcgggaggcggaggcaggagaatcccttgagccagggagttggaggttgcagtgagctgagatcgcgccacagcactctagcctggcgacagagcaagactctgtctcaaaaaaaaaaaaaaaaaaaaaagaaactatccgaatatcaaatttgaataactttctttttttgaaagtttttcattatggaaaatttgaaacatgtataaagaagagagaatggcgtgcacgccccgtgtctctctcaggagtgtgcgagttttcgtgtgcagcctgtttcatccctgcaccgcacaggagggacacacagtgccatctcacctgtgtgtacttccatacatgtctctggaaggtggggctctttatgtcctcaccacacccgagaacgcgagcagccgttgccaggccctgtcggcgggaggagcgtccttggtgacgtgaacacagacctccctcttgggctgtcgtgcttgtcacccacgctcattgtgcccactgtcagagccttctgagaagttactcagatgctctttcagctgacctggttttataggcaagcattatgagttaaacggcacctctgcccgaggtcacggcacccacataaaactggtgaacgttcactttctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggtctccgtggctgcagtgtgcctgtggtcggttgggcctttgtgtgtgctgccccccttcagattggctccctgccctctgagtacttgctctcctgacctccactgatgttgcttcacagcaaggaagtcgagtaggttcaactccagcagctcttggttcatgatttgggatgatgggggtcttggtgatgtctcctgcctcaaggcccctgtggagccggctgttggtttcggggacacaggtggtgcagtcagaagatgcctgcagcccttcctgcgctgagtccagttcttgtttgcagctgccactgtcctcaggtgcctcgatggctgcagactccctgagagcaaccagaccctgctgcggaagctgggggtgaagcttgtgcagcgactggggctgacattcctgaagccgaaggtggcagcatggaggtaggcaccatgagggcggtgcctggggagggccacggggtggggaggggttgctgtggggggcaggcgccattgatgagggcggggcaggtgctgttggggcaggtgctgtggggaggcagtcgccctgttgcggggtgggggaggcaggcgccatggggtggggaggcaggcgccttggttctggacacagttgggggcactctctggagggcaggccgagccgtaggtgagcgtctggtgtggctggtgctgtggcttttgtgtccagtggtgatggcagagaagatgtgttagtaacaagtgttttctgctttcattcatttctttaatcctagaagtgtttctgattttgagaggaatggttttcttttggttattttctgactgcatctcccagttggaagaactgcagctggcgttggcaggaaggtggcgtgtgcgtcgtgtggctcggagtcagcgtggcaggatggcggcgtgtgtgtcgtgtggctcggagtcagcgtggcaggatggcggcatgtgtgtcgtcgtgtggctcagggtcagcgtggcaggaggctggcgtgtgcgtcgtgtggctcggtcagcgtggcaggagggtggcgtgtgcgtcgtgtggctcagagtcagcgtggcaggagggcggcgtgtgcgttgtgtgggtcggagtcagcgtggcaggagggcggcgtgtgcgttgtgtggctcggagtcagcgtggcaggagggtgacgtgtgcgtgatcgtgtggctcagggtcagcgtggcaggagggcggcgtgtgcatcgtcgtgtggctcggagtcagcgtggcaggagggcggcgtgtgcgtcgtgtggttcggagtcagcgtggcaggagggcgtcgtgtgcgtcgtgtggttcggagtcagcgtggcaggagggcggcgtgtgtgtcgtcgtgtggctcggagtcagcgtggcagcagggtggcatgtgtgtcgtgtggctcggggtcagctcagcctccctggcgtggcagcgtgtgtgcgtcgtgttgctcagaggcggtgcggcctccctggtgtggacgcgctgtgggggaaagctgcatcggatcagtgatgagtctgaatgacaggctccctttcaaagactgttggagaaagtgaaaccgcctttcttgctggcagaaatgatgtcttagcagtctgtagcggccggtgtgaacgggttggttctcaaggagacagacttttctagtgttcttagggtgctgtgtgttagcgaccttcagtttgtttcaagtgctataatacgtgtggtttgggaaggaattacttggttaaggtcagctcacactccgtcctggatgatggcaaattccagagacgcgtgttgtgttgcagtgttgggtgtgcagctcactctgtaggaagttgctcattaggcacagtgttcgtggctagtttctcaaagctgctgtggggaatgttcagtgctgtaccaggcagggttctccagagaagcagagcccataggatgtgtgtgtgtcggcgaggctgtgagctggagaccaggagagctcatggtggttcttggccaaaggcctcagggtggagacccaggaagagctgattggttttagtctgaagacagaacaagtccagttgagagattgccaggcaggagggcttcccccctcctcagggagggccggcgttttgttctgctggggccttccgctggctgaacgaggccccctgcatttggcagggtcctctgcctgactttgtctacagattcacatgctggtccagagcccctgacacaagcactggaagcaggtgtgatgaaatagcggggcgccccacggcgcagtcaggttgccatgtaaagttaagcatcacaagcactgaaatgttggtacagaaaataatccagtatcctagttctctcgataatgatgtgcgtgttgccacatacacttcacgtaattctaacgtggttgggttttagtccccgtcttgtgtttttctcttccgtctttctctacgtttcctgtatttctaacttttttccatttttatctcctcggttggattttcgttgtctctgttagtaccgttctcttcttggttgtcttctgttgatgaggacggacttacgctctgacgggctgttagatttctggttcatcccactcctcctgccagccttggctcgaggctttgttagggtgggtctttctcagctcttttcctccagggattggtctttcctccacagcatggtccttgctttaagtatgtagcctttcagggacttaggtgaaagtcacggctttctctcccgtcctgctgggcccgggtctccggggccctctgagggttgcacagtctccaagttctctgcggcactcggcctcccagccattctctgacaggtgcgtctgagtctcgccttgtgcttccttatcttggagtgcccagggatccaagggaatttttgggcagagttttgggcctctgtctcagcagctctcttctccccaacatcctctcccccacatatgagccctccactcattgagattgctgcttcctgggctgtttccttggtacggtgtagaaagtacccctgcggggaggaggtggaggtggcccacctgcagcttcccctcgctggggattgttgccctgccttggttgccatcacctgctggccaacagtggctttaagtcttccgtccgagtctcaccattgttgaggtcgggagggcatgtgtagaagcagcctgaggtcattgtctttgtggtgccgtctggtctttgtgaggtggctgagctgcgcgcttgcgtgaggagaatggcggctggggtgcaccggtctgtggggcgttaggggagactgggggctggggtgtgccagccatgggccattaggggagactgggggctgaggtgcacctgcccgtgggacgttaggggagactgggggctggggtgtgcctgcctgtggggcgttaggggagagtgggggccggggtgcacctgcctgtggggcgttagcggggagtgggggccggggtgcacctgcctgtagagtttaggggagagtgggggctggggtgcacctgcctgtagagtttaggggagagtgggggctggggtgtgcctgcctgtggggtgttggggaagagtgggggctggggtgtgcctgctcgtggggcattaggcatcttgctgggtgtctgatggtctccgccacggtcctaagatggctgatgatactctcttcataccagttaccctacattacagtgtaccccgaaatttagcagcttaaacagtgcactttttcctcacagttttggtgggtctggaatcttgacgtggctcagctgggtccctggtcagggtctctcctgaggcttcttaaacagtgcactttttcctcacagttttggtgggtctggaatcttgacgtggctcagctgggtccctggttagggtctctcctgaggcttcttgaaggcgccggcctggccactgccgtctcaaggcctgcattgctggggggtgtgcttccatgctcctcatgggttgctgtcgggacccggtgccttgtgggctgttggtggggacctgtttgaagtccttaccatgtgggcccctccgcagggcagtgcacagcatggtagctggcttcattggaggctgagaggcgggtggaaaccacggctgtttggaaggtggcagctctcaccagactctgcgtattctgttccttgggagggaatcattgggcccaggccacaccccgtgtgagaggaacgctaggcggtgggggtcgtgggctgtcttggaaactgcccccctccttgtttcctagacttggaaactgagtcccagagggctagagctaggatgagtcattcgaagcaggttgatggcatcagcaccagtgtgtgagttctggttctgccgccaaagcctaagctgtttgtcctctgggaggctgtctcaggctacagccgcagcagctgccctgaactctcactggacaccttttctgcatgagaccggggaagcagggcccacagccaggcggcccgccctgcactcacccttggcaggagcagctgtgtacgcgggggccttgctcagcgcagggctgggctgcacgccgagcgcagactctgacggctcctcacacagctctctgcgtaggactgcgttcccattttatagagggggaagtgggggcatggagcggctcaggagctgttcagaatcacacagcaagtaggcgtagagcaggcctgaccaggagccaggtcccagggtctgtgccatgggccccttcatggcgtgtccaggggatgacaatgcaggttccccatgtgggtgtgaagagggctacacgttgctgccttttgaggggcattcgggaggcaggatctgtaggaactggtgaccggtgagacgcagcacctggtgatgaaggggcggtgtgtggcctgggcggtggcagtggtggccgttcaggaaggggctgccaggaggcagagggtcccgaaggccgggtgcttccccagggaaggcgctggtcctgtcgtctgtgtacccatcatctgccttctctcctgactttccctaatcaaagctggacactagctgaggatgttctggactcggggcgtgttttgtggcccacaccaggatcttcctggcagtttgtgctgatggcactgcctccaggttctcccttcttatccggtctctgcaaagtgcatggaattttcacaggcacgctttaagattcaaagtgacactgaatgactggttccagtcatcaggatgctgtgagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgccggcactgtctggccacccgtccccttcgctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactcccttaaaccacattacaccttgcaggggtctccatccactgccctgttctcctcctgtggggtctcctgctgcacagagacagagccatcagcggagcccctcatggcggccatcctgggctcctgtccacacactgtcctgccctcctgccgcggttggatgaagtcttccctggacccaggcagggcctcttcatgtcccctccctgtgaggcccccatcctcccagtatctcccagcttcctgatgggcaggcggggccacgctgcctgtgctgtgctgcactctgctcacatccccgccgctccctccagggcaggtttctccccagtcatctgcaccccacctcgaccgtgaccatcagggcgcctgtggcaccgttgccagccccgagccagcatccactccggcccttcccttgacctttgcttctcagagccctccctggttgcgtggtaggcgcccgcatctgtgctgggcggctctgagtcccgggcggggccctgggtctgccccttccccgtgtccgcagcctgccccaggttcattcccgtctcccacccgctgcaggcagtcccccctgcccgcattccagctgctgtgctggctccagactgtctctccaccctcccctgtggtcactcagcgagcttgtccatcagggtcttcccagggctgcttggtgcccacaggcgaaggcttcacccttgctggggcttgcagggccctcaccgtgtgacctgacccctccctgcatcctctaggcttctgtgtggttcttaaaagttcagcctgccgccaaggcctggtccctgggagagacgtcttcgtgcagccgctggctgggggttttctctggaagcttcccagcccactttggtcacccgtgagctgcgggctcttcccctggcctgggtggggcccttgatgttggccttcccctgggggcaggcagctgctccctgtagccggctttaatggggtagatctctttcttaggaacagagaacttgggaacatggctgtatgtgatgatttgagaacggagggaaggaaatgttcttttcctgtcattaaaattaatattgttaatgtaattcccttcggcgtgtgcactgagtagcgtacaggatgggtcaccttacagctgggaaactaggaactttgtgtggactctgtcacgcatcaccttcctcttcctacagagcagctgctggtcgggctgaaggacaaggacacggtcgtgcggtggtctgcagccaaggggtaggtgtctgtggccgcagaagcaccccggggggtgggccggcctctcctgtgcgattcagcagctacaaatacccaacagctttggagtggcagcgcggccccctcctcggccccctccaacttatgtgtgttgctttacgtgttggcgtgaagatggttcccgaggcggagcttcggtctcctccgtcctcctgcctctggctggccctgccgggtcacgagcaggccgggtttacctgtttatcttcaaaatgttcccttgcttttccacatcctcatcactgtgccccccacctatcgttccccacagatgggggtcacggctcctacaatgacggtgctcagggaagagccctcttttgtggggtgagcaggtgccagtccctcattcacccctcactagcacctgtcatacctgtgggagtcgacatgcaccctgcaccccaggcctcagtggaggtcgtggggcagatccagtggggcctggccttgaacacaacaggtggagccctggcctggaggagccggtggccctgtgggctcgggctgtgcagggacagcgatacacgtgaagaagatgctgaagtgtcggggaggcccctgctgtggaggagaggaggcaggtgcaggggccagcaggtgctgaggtgtcagggaggtaccttctgtggaggggatgaggcaggtgcaggggccagcagatgctggggttgggggaggcccctgctgtggagaggatgaggcaggtgcgggggcagtaggtgttgaggtggggggaggcccctgctgtggaggggacgaggcaggtggaggggctgacaggtgctggggggcggggaggcccctgctgtggaggggatgaggcaggtggaggggtggcaggtcctggggggcgggttggcccctgctgtggaggggatgaggcaggtccaagggctggcaggtgctggggggcagagagaaccctgctgtggaggggacaaggcaggtggaggggctggcaggtgctggggggcagagaggcccctgctgtggaggggatgaggcaggtgcaggggccggcaggtgctgaggtgtcagggaggtccctgctgtggaggggacgaggcaggtggaggggctggcaggtgctgaggtgtcagggaggtccctgctgtggaagggatgaagcaggtggaggggctggcaggtgctgaggtatcagggtggtccctgctatggaggggacaaggcaggtggaggggataaggcaggtgcaggggctggcaggtgctgggggatgaggcaggtagaggggccagcaggtgctgggggacggggaggctggtttttgccattgctctcccatgcgtctgtgctgggtccgtccataccatgatctctgggaggagctccacagggctgtgcaggggctcacataggcctttgtgttgctgtacgcaggggatggcttttcagcccagagcctcgtctggttgggtgtgatgggcccacgcagtgagaggctgggcaggccttcccagtgtccttcctggaggcccctggccaggaccttccccacggggccatctccagggacttggaccctgtgagccagcctcaggcggcctccatgtggggccgtgagcccatcacctggcctgatgggtgcctgcacagtcagcgtttggggtggcacagaggaagcccggctccagtagggagggtcagggtgaagccctcagcgttcgcctgctgcctcggtaccctcagccgtcactggtggcctgcagcgtccgcgttacagtggtacatggtgacctaccctgtgccgcgtgtgctcactcgtcccctttgaatctggctgcaggctcctttaccctgcagcgtgttttagcgcgggggctccaagcagggtgcgggcttgcctggagttggcctcttctctcctggtctctggaggaaaggatgggtgttcaggccattcacacgtgtcacgcatgcccttggcgacaggctggtggtgcccctgacggattgctgcgtttctctttcagcatcggtaggatggctggcaggcttcccagagccctggcggatgatgtggtcgggtctgtgctggactgcttcaggtatgtgagaagagcaggggaggcgtgtgggcctgaccctgagttgagaagccctggctttccttatatcctttcacgcttgcttttcattgagctgtttgtcagaactccagaagctcttttttcccccttttgaagttaaacttgagaactcttgttatttctggtatgttgcttttatcaattccattctatttaaaaaccttaaggaaaaagagagtcagtttagacatatacccatgtagatgtttattctgaaaggaaaagctctactgagtgagttggggctgctccgagagctttctgtgggaggttcgggtctacccctcgcctacccattagccacgtgtatcactcagaccttgaagtgaggctggtgtgaccaaggcctgagtttgaattggatttcattttaacgaaatgtgaggctttgggaggccaaagtgggaggacggcttgagcctgtgaattcaagaccagcctgggcaacgaagcgaaaccccatctctacagagagttaaaaaattagccagacgtggtcccagctactcgggaggctgaggtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtaagttgtgggctgggatgtgcgggtggcagggcctgggatttcagcctggggcctgcagtcctgccctggtgtgctcacacgtgtgaggcatcgatctgtgacctccccagggaattctcccttttgcttgtgtaaatgtctctcccagtttcagaagcggagggtcgagagcaggcgtccagcttgctcaggaccccgggcgtgctgttgctcttcattagcctggacaccgtggcgaaagctgtgctgtcagcactttggaggctccagttcgcgttgcctgtcagtcaccagggacagctccggagccgttcacaaagccttgttttccttctggaggagatttcttgtgcacttagcctccagcctgctcagtgacaatttcaggagcacaggaaacaatgtgtcagatacgggtcatgtttttcagagcagtgtgcatgcatgtgtgagaaatattcttccagtggaaacattgctagcagaaaacatgctctttaccacaactgcttgatgggaggcaggggttggagggtgctacgtgcttggcttctctgtaggcgacctccagccttgtttcaggcgtgtccctggagctcctttctggtggtcatggtgggcatatgtcctcctgtcgcctggtgccacctgcggccttcacaacagtgtggtgggctccaggccgggcctgcctgtgcctgtctggactttgcctctctcctccagccgctgggcggcctgctcatcaggcctagtgcgtctcctaaactcactgtgtgtctttccctccacaacgtgcagcctctctggactgtgtgttccttactctagctcaccttcttggtctagtttcatttttcctggctggtttaatcttcaggtgctttttaacctttatttttgttattttaatgtgctcattccatttttgtagctaggttctgggacggggtggcctttttactcttgatttcgcagggccttcatcccaaagtagctgcagggccatcatcccgagtcctcgcaggatgcagctctggtcagtgcctgccttcccttttcctgggtgctcagtgtgtgattgtcaaccgtggcataaaaaggcggctctggacagcgcctgctttccctttcgctgggtgctcagcatgtgattgtcaaccatggcataaaaaggtgcagcctcagagcaggatgtctgaagacaccaggaagccaggagttgctggggtgtggggcggcccacagccctgcatggtggctgctccaatcttgtccttccctgggacgtgtggtaagctgccagcctcttctgaaacgggtccgagaaagggcattaattatattaactgtaagaacacccagcacccaggagggttaacttactccccgctcctttcctgggctgggttatgcagtgagtggaactgcacccatccccagggggttcaggatctgtgtggctgatgtggctgtcccccaagcgtgcacgactccctcaggacctggggccccctcctgactcccatcaccagccctgcagcattaccctggacctaggaagtagcgccagaccccaggctgtggcagaagcagggtgccttggagaggagtgtgtctgtgtctgtgccaaccccattggtttctcccgtgagcaaaccaactgaacctgtgcccgggcccagctgtgggtcctgctgacttgcccgagggcatcttctgagacactcggtgtggagcgtctggaagccacggcactacgctgtgcctccccctcgcccgccgccccgtgtcagcaggagcctcaccacgtgggttcctttctgttgagctttacggtttcatcgaggttttggactgggtgatgtgttcattcaaaagtcaaaccaaagggaagaagacagcctccccagaccccagagcccccccgcaggtgacctggggcacccgtttcgcatccctccggggactgatgcaggtgtgagcagatggatacagaggttttcttgttttgtttttgagatggagtctcgctctgtcgccaggctggagtgcagtggcgcggtcttggctcactgcgatctccgcctcctgggttcaagccattcccctgccgcagcccccaagtagctgggactacaggcgtgcaccaccacgcttggctaattttttgtatttagtagagacggggtttcaccatgttggccagtcgggtctctgtctcctgaccttgtgatcagcccgcctcggcctcccggagtgctgggatgacaggctgagccaccgcgcccggctgttttgtttttagagatggggtcttgctctgttgctcaggcaccatgatagctcactgcggcctctacttcctaagttcaagtgatcctcctgcctcagcctccgagtagctaggactataggtgtgcagcaccacacctggctaattattttatttcatttttgtagagatggggacttgctatgttgcccaggctagtcttgaactcctggcctcaagcagtcctcttgcctcggtttcccaaagtgctgggactatagacctgagccctgtacctggctaaaattgtctctttcattttacacagataatggcttacttgtcacactttaacaccaaacgcatctttgaggtcattttacattagtgctgttccccttgctcttgatgatctgagacccgtgtacctgcgacactctttacccgcctcctctctctctctctctcttcctctcccgctcatccgcccactcatagcttccactattttctgttgtcttccctcctctgagaccccccctgtgcttccaggagtgccttaagcttggatctgagggcgggaactcgccccggctgcttggcttctccctgtgcccctggtgtccatggacagggtcccctgtccggttccactgtgccgtggtggtgctgggcctctgaggcgagccggatggacggacggcatcccctggaccctgccacccttgccaccgtgccacagtgaacacgtgtctgatttagaagtagacattggtctgacaggcatttgttttggtatttttaagtcacggtaaccttggtgttttgtcaagttcattcagatgttaactaaatctttgtgaaaggtgtgaagcatctttctccaatgaaaaccctaaaggacgcaagtgctgatgtgaaaatacgcaaggggctcacggagcctctgggcagacagtacacgtctggaacttgtttaattgtgattgagtctgtcggtgacagtgagctctgaggagcccgctggtggacgctggtgtctgtctcagcccctcctctctgggctgggcacgcaggaggtgaggcagccactgggcggacaggcactctccgattttcctaagtattcttgtccatactgattgccagctagtcatacaatttagtgggttttcctaaacatttatttgctgtcaagtcaatttaattagaatcaggagagcttctgaaccaccccggggaaattagtacgtataaaatattatgacttgatcgatggccattgcaattgttcattaaaagttcatatttcaaatactgtgaaaaatcttgaaatgccaattcattattgtagcatttaattctgagtttgactaaacagtggggtgtcatttaaagaaggtcttcctgctcccttttccactgacgtcttcctgtgctgggattcctgttttaagttcctacttttctgaagtgtcttatttctttctatgggagcgtgggtgttgcccgtacttggagcgacaccactgtggtgggaaaaccccacctgggacggcacagacgggacggtctctttgtttggggactgaccaagacttgtcctcactctcgggagatctgaagaggccctggggtaggcacggctgttgtcttcatactcagttgcagtgtgttatttcttcagccaactgattatttgtttttttattttgagacggagtcttgctctgtcacccaggctagagtgcagtggcgcgatctcagctcactgcaacctccgcctccctggttcaagcgattctcctgcctcagcctcttgagtagctgggattataggcgtgagccgctgtgcccagccttgatactttaaaaacttaggaatgggttttagtgagccttacgtgagccttacaggcagaggatatggacctgccaggctgtgctccttgccatgctgtgggctttgaaccaaaagctgacacgtgggctgtggtctcaggatctttgttgctctcagtttccaggagactgacaaggcgtggcatgggggatgtctggcgctggcagagctgggcaggagaggcctgttgctgccgtctcgactcgtggatggtgagtagctgaggcacggtcaggggggatgtctggcgctggcggagctgggcaggagaggcctgttgctgccatctcgactcgtggatggtgagtagctgaagcacggtcagctgcgtcaccaggctgtccgtggcaggctgcagcccttcgtctgaacccatctccgcggtgtggccctgccgcgggcacgcccagaagagcttgagaacaaggtctgtctacctttttctcgcattggcctttgtaatttcctaattgcctcttttgtctgctgtggaattttaatgccacagattaccctgtgtagctggttttggagggccacgaatccttgtaatgtctgattttcttactccccaaaaccggttttcattcttgagggacattgtcgccccttaaggacacatgcagtggcacctgcttcagttgtagaaccaggtacccctggcagcatcctgggtcacctggagtgacgtggtgctccctggagatgaggctcacgccagcgtgaaaccagggtgggaactggggtggagggccaggggagctctgcagtggccagcagtggggtggggacagagggcacagcatggcagatgcaggggcactgccccagaccagctcttgtgccgtggccacacgcagccctgtctgtgtttggtggggagagtccctgggtgtggctggcagtgccctctgagggcaggaaggaaaggatgtctgtacaggatagagtgggggcccatcctgagagggcctcaccacagagacttgattctgtccaaaataaagacacctgagatgtggtggcctcacgtcttcccagtgtggagctgtggtggcgtctgaagtgaccgctttgcacttggcattttgatgtatggggagagcttttagagcctgcagttcttttttttaatgtctctgcttatttttttccagacttctttaatgtttagacctctttattgcgatctaatttacatgccataaaatgcactcatttaagtgtacggttaagtggtttttatatatttacagagttgcgcaactattgccataatttaatttccgaacattttcattgcctccaaaggaaccctgtgtttaagaactcactctttactctccccagcacccccgccctggcagccatgtctccagtgtctctgtgaatttgtcttttatagacatttcctaacagtggaacctacgacatgtgatctttggcgtccgaattcttcggctgagtttctctgtgtcgtagcctgtggagtgcctccttccttcctgtggcagagccttgtcctgctgtgtaaatgcaccacacgccacgttttgtccatccttttcatcagctgatgtacatctgggttgtttccacctttcactgttaggttaatgctgccatgaacatcgtgtacacgtttttgagtggatgttgggtgtaggcctagtagaaatgctgggtcatacggtaactccacgtttaactttctaagaacctgccaaactttttccaaaatgattgcaccatttcaagttcctgcctgtagtgtgtgagggttctgcttctctgatcctcaccaacacttgcttttatctttttttttttggacgcggtttcactttgttgcccaggctggagtgtggtgatgcaatctctgctcactgtaatctctgcctcccaggaccaggcgatcctctcacctcagcctcctgagtagctgggaccaccggtgcccaccaccatgccacattaatttttttttttagttttgttagagacagggcttcaccacattgcccaggctggtcttgaagtcctcagctgaagcagtccacccgccttggcctcccagagtgtggggaatacaggcgtgagccaccacacttgccccctgcttctttaaaaaaaaaaaaaaaaaaaaaagccgtcctagtgagtgtgaagcgccaccttgttttgcttttcatctgcttttccccagtgactgatgacactgagcattttctgtgtttgcccgtttgtatgtcttctttggagaaatgtcttttcaagttctttactcatttaaaaaaatatttttttaattgttgttgtaagtaagagtttttttatgtattctggatataagtctcttattggatatatgatttgcaaatgttttattgcgttccatggttgccttttcactttctattgattgattgacagagtcttgctccgttgcccaggctagagtgcagtggccccatcacagctcgttgccaccttgatctcctgggctcaagccatattcccaccttagcttcccaagtagttgggactacaggggtgcaccaccatgcctggcaacttttttttctttttttgagacaggatctcattcccatcgcccaggccggagtgcagtggcgtgatctcagctcactgcagcctccacctctcaggctcaggcggtctgcctacctcagtcccctaagtagctggggctacaggtatgtgccaccatgcccagctaatttttgtattttttatagagatggggttttcccatgttgtccgggctggtctcgaactcctgagctcaagcgatccccccgcttcagcctcccaaagtgctaggattataggcgtgagctactgcacctggccttcatgcctggctaattaaaaaagttttttgtagagatgggggtctcactatgtggcccaggctcgtcttgaacttctggcctccagtgatcctcctgcctcagcctcccaaagtgctgggattgtaggctgtacctggtgtgttttcaatttctttgatggtgatatttgacccaggttttaaattttaattaagtccagctcatcagtctttttctttcttgtgtttctggtgtcatagctaagaaatcattgctgaccccagaaccatgaagttgtggtttcatttaacgttttgttccatccgaagtaagtgactcgtaatgtttatttgtgacactagatgtgtgtgagggtgtgtgtgtgaatgtgtagctgggatggaatgaagtccctgcctgtggggagccagctccaggttcactcaaaggagacaagagactctactggcttgtgtgtgtgctctgtcatgtcttatggcaacatgcactgaccccaggcagctggggcgagaggatatgggtgttggcatcataaacgaaaagggtaaagctatggttcagaaactgacacgtgatgtggaatacactggcccatgaccttcgcatggttggttggccccttctgcctggcggtgccctccatgtgagctgaaccctctttgcagcccccattctgttcctggtgggacatggagaagctgtgctgtctctgcacagggcaagggttctttcaggcaggggtgaaagagatcccatcttggggctgactcaggaggtgacagggctgacatttgatgagcatttgcagcatgctttttatgtttttgttttagacctcacaccattcctctgagagccgtcttgtttatataaagctatagttgggagccacgtgtggtggcggtgcctttaatcctagcctcttgggaggccaaggcaggaggatcacttgagcctaggaatttgataccagcctggacatcatagtgagacaccctctctgaacaaacaaacacacacacacaaacactgcagctgtgggagccaggaagtctttctggtgtcacagctcatgctcagcccttcggcctcctccatgtcacacggctgagctgtccctgcacctccttgtctccttggagagttactgtggttctctgtcagtttggtttgaaaagtgaaaacaggctgggcacggcggctcatgcctataatcccagcactttgggaggccaaggcggggggatcacctgaggccaggagttcgagaccagcctggccaacatggtgaaaccccgtctctgctaaaaatacaaggatgtggtggtgcatgtctgtaatcccagctactcgggaggctgaggcagaagaatcgcgtgaacccaggaggcagaggttgcagtgaaccgagatcgcaccactgcactccagcctgggtgacagagcaagatcctgtctcaaaaaaaagaaaaaaaagcgcgaaaacaaatgcttggcaaataaatgtcgtagaaagacacaatatagatgagcatgtttgatgactaaagcttttgtttgtcttagaggaaatgtggagcttcattggtgcatgctaaaggaggaagaagtaaaactagggaagtcaggtgggcaggcagtgatgcgatgtttgcctggaaggcaccctgggtctttctgcccttagtcctctgaatagggggactctgcctgctggactcaggaaaaaagcatcgcattttctttgggttactttttagggaatcctgctgattcctctccacacatacagtgcacacacacacagaatctccatctgttgtgctgtaagcctatttcttggtctctgactctgtgcacaccaccacgcccagctaattttttaaagaaattcgaaagtagcctgcgcaacaaaatgagatcctgtttctacaaaaattgttttaaaaaggtagttgggtgcagtcccagctactcaggaggttgaggtgggagaattgcttgagtccaggaggttgaggctgcagtgagccatgatcgcagtgctgcactcacgcgatcctcctgcctcggcctgtggacagtgggccatgttctttttctctttgcatcatcacctctgtttgaggactactgttaaagggctacttggtctttattttaggtgattcaaattccaggacttttcttgagtggtcctggcgtaggtcctttcaccttttttgtggctcctctttgaacacctctgttgttgtggcaggaggaggtgggcactcctcaccatgagtaagctcctacaatgtttgtgaacccttacggtttcctttgttggatacaagaagcacaggtggggggatgtattggtttaagtttaccttttttttttttttctttttttgagacagagtcttgctctgttgcccaggctggagtgcagtggcgccctcttggctcactgccagctccatctcccaggttcaagtgattctcatgactcagcctcccgagtagctgggagtcaggcgcccgccaccatgcccagccaatttttttatttttagtagagaccagatttctccatgttggccaggctggtctcgaactcctgacctcaagtgatctgcctgccttggcttcccaaagtgctgggattacaggcgtgaggcactgcgcccagccaactgtactattttgataaaatgtatacatgtgctccttattatgcattttgtggttttcatcagtattttgctttttgaaaaatgtcaagtgttctgatctctttggacattttgtatgaaccctatttcccttgctatccttattgattgagaattgtgcatattgatttgggtaataataactagcacttggtgtttttctgagcttggatgtgtagattcatgtctttcatcaaactcgggtagttttcagtcattgtttcttcaggtatttttgctgcccctctcctctccttgtgggactcttgttatgttaatacacatgttggtactcttggtggtaccctatgagtctcttaggttttgcactcatttcagctcttgagtcttcttgttatgttaatacacatgttggtacgcttgatggtgccctatgagtttcttaggttctgccctcatttcagctcttgagtcctcttgttatgttaatacacatgttggtaagcttgatggtgccctatgagtctcttaggttctgtgctcatttcagctgttgagtcctcttgttgtgttaatatacatgttggtaagcttgatggtgccctatgagtctcttaggttctgcactcatttcagctgttgagtcctcagttccagaatttctctttagtttctcttttaataatttctttttgagacagggtcttgctctgtcgcccaggctggagtgcagtggtggtatcacggcttactgcagcctcaacctcccaggcccaagcagctctcccgcctcagcctcctgagtagctgagaccacaggcctgctgcactggaaaaaaaaattgtagaaacaggatctcactttattgtccagactgctttcaaattcttggactcaagtgatcttcctgccttggcctgccttgggattataggagtgagctgctgtgcccagcctgtttttataatttctgtctctttatcaacattccatgttagtttaaatgttgttcttttggtctcctttagttctttgtccacagttttcttgagatctgtgagcatatttttgtctaagactgagcacagtggctcacacttgcttcccagcacttaacctttgctttaaagcctaaaaaggaagaaatctttgcatatgtgtttcccaaataacagatttgagggctgtgttggtgacataggtctgtttatacccactgtgtggctaaagcaggtctctgttaaattagcatctacaaagcttttctcctgccttccctcaaacttaggaagctccctatgcaatcttcaggctggggtccttcactgccccctctcaaggaggcctaccccttcccccagaaggtgcagtctgtcaccccatgtcttataaagtgtaatggtctggtgtcccaaagccacagagaagcccattctaaccttcctgcaactttctgaaggttggagagcatgtttgttttactgctaggaggctcaaggtccctgtgaacctgcatcaggtagtaagccctgcatgtcggaaatacagactgcctaactcttatctaaggtgatgttttgagaaaatttttaaatgtataatacattttataaatttcgaaaaaattttaataaacattaaatttttataagtttatataaatgttataaattttgaaaaatgtacagagttgcattggagcacacgctctcagtgttcatcgaagacgtacaagcagcgtcttacgacgatgttgctgcagctgccttggggtcttgttaaaagcaccattcagtagattaattcccacctgtggactgtgttttctggcttccaaaagaaactgtcatgtttttctctctggatgacgaaaactctgcacgtacttcctatgacaagtgcgattggcgcccactgctcttggcagttgaggtgaggacacagcgtttctgtgacggtgaaggggacagggtttggagggagattcagacattaaacaaggaaacgaagggagcaatttcagagaatggataaagtcgttaagaaaatacaaaagggcggtgagatcctcagtgatggggccaaccagtgacttgaataagacttggggaagacctcctggggcgacatttacgctgagagcttctaccgtgaaggagccgagcaggatggactcctgaccgcagcatctcaaagaggaacgaaggctcgcacgagctgggacagcggaaagagcagaagagtgggcacagaaaagcgcctgggggccagatcctagaggggcttcaggaacacagtgaggggtttggaaattattcaacataaagtcagatactggggaatacacgggggtgcagtggaaaggaagagcgagggagagtgaggccattcgggagccaccacagtgttcggagtgagaccagagctgtgaagaaagagaaaaggaaatacgctgcatgtaggattctgaactcaacgactttgctgttctattcagtgaaagagagtgagatagtaaggtcagtgagtgacatgttggagccttccacatagtaatggtctacaaagttatggattgatgagttcacacaggagggagtgagagatgaggaaggtgaatgggtggaaaagcttgaaccgggttcccaggctcactggcatggggaggtggagaaaaggggaggaagcagccgacatggaaacccgcagaggctccttcagaagggatattttataggagaggagtccgattctgagagggggaaggggtggaggaccagagtttcctcacaggctctggagcactgaggtggatggtaaattccaggagagcagctccagctgaggtctagggacagggcattccctccctggtagagccgttggggctcagtgccgaggctggctcaggctcttgtggggggccctgctgtctgtccagccctggctgtggcctggcctgaccctgctgccccctgcaggcctgtgtacctcagttcccaggtgatcaaggggccctgggagaggttgggtctgagcacgtcctgacatggccccagtgtccagttccccgcctgtttttgttggcttgtttaatcttggtaggcttttaagctttcaggttttcaggaaaatgcaaagcatgagacatctttgactttgtacgtggaccgattgttctttttttgtgttaatggtgtttttttccttgtgtgaacgtgtgtgtttcgtgttgcactccgccctgctctccctccctccctccctgtagaacgtggcattttggctgaacgttaacactggtgggggcagacggcagtgggcccccgttaagactgtttagaaagggcgttgtcggcatcttctcttacatgtgaattcaaggatcctttattttttttcagctttattgatatgtaattcgtctaccatataattcacccatttaaaatatatagttccatggtttttagaatattctattattacttagaaaattgtggcaaaatatgtataacaaatttgctctttttattattaagcatgttaatccagtggcattaattacactctcacttttgtacaaccatcaccattatctggttccaaaacttctcatcaccccagattaagaagtcactcgcccctgatgctccttcccttcaaccctttgtaactctagtctactttctgcttgaaaaaggactttgcctgttttagagatcttgtacaagtggaattggacaatatttggcctttcatgtctggcttattttatttagcatcatgttttcaaggttaatctgtgttgtagcatgtatcagaattttctttcttttaaaggctgaataatatttcattgtatggacataccatatatttatttattttatttttacttttatttttatttttttttgagacagagtcttgctctatcacccaggctggagtgcagtggtgcgatctcggctcactgcaagctccgcctcccaggttcacgccattctcctgcctcagcctcctgagtagctgggactacaggcgcccgccaccatgcccggctaattcgttttgtatttttagtagagatggagttttatcatgttagccaggatggtctcgatctcctgacctcatgatccacccaccttggcctctcaaagtgctgggattacaggtgtgagccaccgcgcccgacccatatatttattttttaaagataggatctcactgtattgtccaggctggagtgcagtggctattcacaggcccaatcatagtacaccacagcttccaactcctgggcttgagcgactctcccacctcagcctcctgagtggctgtgattgcaggtgtgcaccaccgcccctggccatattttcttgatccattcatttgtcagtggacgcttgggttattcccaccttttgggtattgtgaataatgctgctgtggacatggatacaagaacctgtttgacacccctttttttagttcctttgggtatataccctgaagtggaattagtgggtcatgtggtaattctatgttcagctttttgagagcttatcactttttgtatgtaaaaattacgagtgtttagttcttaagtcggatcatgcataaatgcagaaacgtagttaaaaaataagtctcttttttttttctttttgctataaagctctaggaatcgattttgcttttagagatagacacaaagggcttatcctggttgcaatgggtgagctattgcagatgacctttggaggaattgtgtcggagtgtagaattttcacagtgtagctcgccatgcatcaggcacatgtagcctgtgccacaaccattgtgcttgggcggggttctccatgctgccctgttgcaggaggatgctctgcccctgcttctccctatttgtcatttaagatgattcctggtgctttttggtgagcgatcaaatggtgttctcagaatctttgggcccttgacaacggagggctgtattcttgggggtgtgatgtgagagctccttgtctgcagggtgtgaggctttgggtcctgagtgtggaccgtggcatgtgatgtcttgtcacggctccctgcacggctgtttagtttctgaaagctggaagtataatatttttgttctttgccaaaacatactggtgtatataaacagaagtgcccaggtgagcgactcagcactgcgcctgtgtttatggttctgcgtctgaccgtgtgccttttaggctggtgtagtggttgtctgaggtgggtgcctgacagggctgggggacctgctggtgtccttgctgctgctttagggacagcttgaagcagtgtcctcagataccccttggaattgtgacaaactctgtatccctcttacaagttttatagaactctaaccagttgcaaataactatttgccatcctgagtattgtcattttaaaataaaactattgcgtcactcatctgaataaatctgggaaattgaggtagaataatctaccattcttcgttaaaaaatttacagggctgggcgccatgtctcacatctgtactcccagcactttgggaggctgaggtgggaggatcacttgagccccgggaggttgaggctgcagtgagctgtgatcgcgccactgcactccggcctgggccagtgagcgagaccctgtctaaaaaacaatttcataggcaagtttttctctcacagaaattttattcttcctttttcttcttaagcccatatttccatttacttttttcccagagcattttaccctaatgtaatgtatttctgtgcctaagaatctttattgatctatcatttatctgcaacgaaagaaaataacataaacataaacttcaacttttgcattttgtatggccataagatgctagttatttatttattttttccacaggtgttcatgaccttttttttttattatttttttaactatacttttaagttttaaggtgctagttacttagaagtttttttagattgggttttaaaaaattatgagtacagagttgaccaaaacaacataaaatagcatattattgaaatttagctcttaataagatagctgtttagtttgagttatcttttgatgagtcaggctttttttgtttttattttttgaaatgattcttgctctgtcacccaggctggagtgaagtggtatgatcttggctcactgcagccttgacctcctgggctcaagcaatcctcctgcctcagcctctcaagttggtgggactacaggcaaacatcccattgctcagctaatttttgtattttttgtagggatggggtctccctgtgttgcccagactggtcttgaactccttggctcaagcagtcctctcacctcagcctcccaaagtgctgggattatgggtgtgtgccaccatgcctggccgtgagccatgcttttaaccagaataaggcaaggttctgcaacagtacaatttttgctttttatttatgtattttttttgagaaaaggtctcactctgtcacccaggctggagtgcagtagtgtgatcatggctcactacaacctctgcctcccaggctcaggccatcctcccgcctcagcctcccaagtagctgggaccgcaggtatgtgccaccacacctggctgactatttttattagagacggtgtttttccatgttgcccaggctggtctcaaactcctgacctcaagcaatccatccgctttggcctctcaatgtgctgggatgacaggtgtgagccactacgcccggcccctatttttactttcagttttaagtgctaagaagtcttattcattcaagtcttattcaagtagctaggaatggcagaaattttgctttagcaatgctggtgtttcaactttttccaagctcacgcctgacctctgtgctctgtcactgagcagcttcagtagggtggcctcagtcctgtgaagtgatgcgttgacagccacctgcatggggaagcatttcccagtctctggagcagttcccatcgtagtgtccactgcatggtttccagtgtgttgggtgagaggctgcctttcttgaaaagtgagagaaagggctgttgtgagaggggacatggggatggagaaaccctttctcaagcagagccttaggggctgaggctccggaagtctacgctcctaaagcactctgaagcctgaggaccccatggatggccattgagtagccccaggggtgcttcgcacatgccggtacttgaccactgctttaaacccatgtgcacacatgcacgctcacacacatgcacgatgcagaagtgcatacacacgtgtacatgtgcacactgacacatgcacgttgacacgtgtacacccaatcgaatgtgcacaactacccccacagatagcacacacccacacaatcgaatgtgcatacacccacagatacacacacgtgcacacccgtacaatcgaatgcacacatccgcagatatgtacacgtggacacccacacgattgaatgtgcccccccacagatatgcacctttgcacacccacacaattgaatgcacacacacccccccacaggcacacgtgcacacccacacaatctaatgcacacacacccccatagatatgagcacgtggacacccacacgattgaatgtgcatacactcacagatacgcacacatgcacacccaatcgaacgcacacacacctgcagatatgtacacgtggacacgcacgattcaatatgcatacacccacagatacgcacatgtgcacatccacacaatcgaatgcacacccccccgcagatatgcacacgtgcacacccacacagttgaatgtgcatacacccacagacacacatgcacacccgtacaatcgaatgcacacacccgcagatatgcacacgtggacacccacacgattgaatgcgccccccacagatatgcacatgtgcacacccacacaattgaatgcacacacacccccccacaggcacacgtgcacacccacacaatctaatgcacacacacacccatagatatgcgcacgtggacacccacacgattgaatgtgcactcacagatacatgcacacccaatcgaatgcacacacacccgcagatatgtacacgtggacacgcacacgattgaatatgcatacacccacagatacacacacgtgcacatccacacaatcgaatgcaccccccccgcagatatgcacacgtgcacaccggcacaatggaatgtgccccccccgattgcacacgtgcacacccacacaattgaatgcacacacacccgcaggtacgcacacatgcacacccacacaatcgaatgcgcacacacctgcagatatgtacacatgcacacccacagaatcgagtgtgcacacacccatacataatgcgcatgcactcacatgattgaatgtgcacacacccagagatgcacacacacacatctaatcagatgtgcacccccacacagatatgcacatgtgcacacccacaggatcgaatgtgcacgcctaatcagatgtgtacacccctcccacatatgtacacatgcacactaacacaaatgtgtacacacccgcaggtatgtacacatgcacacctacacagtcgagtgtgcatgccccccacggatatgcacacgtgcatacccacacaatcccatatacccacccccacaatcacgtgtacacacccccgcagatatgcacacacgcacacccacaggatcgaatgcgcacacacccacagatagcacacacgcacacccacacaattgaatgcgcaccccccacagatatgcacacgtgcacacccacacaatagaatgtgcacacacccgcagagatgcacaagcgcatacccacacccgcagacgtgcacatgcacacatccacacgatcaaatgtgcacgtgcatctgcagacatgcacaagcagacacctacacgcactcgcagacatgcacacccacatgggcgaatgtgcacaccccccccacacagatagcacacgtgtacacccacacaattgaatgtgcatacacgcacccgttcacaggttaatcgctgccacagctatcagctctttttcattgactgttacggcaaaatattctaaaggataacatagatttatgtttatttgcattttatgtttccttatggttcatatgagtttattggaaaattagcaacatacacatcattttggggaatggaaagtgaggcagagtaagccagaacattcactgtaacattataagcaagtagaataaattgataataccttcaccagtaatgcactttccctagtggaaataaattatttgtataaatagcctcttgatgtttgtgtgttatttagttatacaaatcacatttttcttttttacatatggcactttaatgttagtactgaaaatgttttttctgacattttttcagtaattgtcatttacatcaaatatgcagctagagctaatagaaaaacagttaaaacaatttgttgtaatggtgagatatttataaggaaacatttataaaagatcttctgtaagacagcttagacttgaaaatacatatcagtcttagagtcattcaggtgtttttacaaccaaaagtagaagcaccttttaatattcatgcttaatatttataaaaactgaattggagggttttttgtttgtttgtttgtttgtttttttgagaagcagcagctgcatttgtaaaaatgtgaaagtgccagttcagaggtgttgtagcttgccaccttggaaggcgtgtgtgtggccgtagctctgtgaacacacgtgtgaacccggcgttaggacacccgggccctccttcgtagtgtgaacactctggccgtgtcctgcagcttcgccttcttagctccttgctgggattttccagcatcccttagacttgtcctcttttgtcctttgggtctgaggtcacactgggcctcttggctctccatggagctcagtgtgggtgtgtcttgccggcaggcaggttccggggccgcagcatccccatcgcccacccggatgttcctggggctgtaggccgccagctggcacagggccacggctgccgtctgcttctgctcctcgctgctgtccaccgcgcatgcgtctggagcctcctcgccggggcctgtgggtggggccccgtcaccgtcgaggctgcctggcttggtctcagggtggctgggcccatcctcagaaccttctgtcccagtcttctgtggaacagcagcagcaggttctgcagctcgtggtcgaccggggaaggcaggcctcggagcctgggtgttacaggggtccttcaccgagagattgagtggaaggtcctgcagctctgagaagctggcggtttccgcctgggggctgccttggtacgtgggttcgtgggtggctgccaggtttatctctgatttcttggagaggttgagggggcccatcccggagctgtcgtccggactggaaggcgcggcctccgagacgagagaggcgcttccggtcggagcaggagggtctccgttcacaacattgaggctagaagaagccaagaaaaagcttagtaggagcttgcttagaaaagcaactgcgtgaagcagtgtgagcaagtataagcctggctcatggaacccaaccagaaacattcccttggaggttttgaaaatgacattttcttaccttactggagactctgctgtggtctcagcagcctgggcaggtaggcattctgtgcttttcttaacaggcctgaaggctgtgaggctttgctctggcgggtagagtcttcccagtgcgctggaggctgccttgttggagaggtcgtacaggccttcgcaggtctggctcgtctgcatgaagtcggtggggctcggcctccctggggagcccgtggctgcactccctgcgcgggggctcattttggacccttccgtgtctctctgcccagccttggaggagtctttagcctcaggaattggactttcgaactcgacgtgttttctgttggggtccgaagggtttaacctggaaggactcgaggctggatagaccagggtggcttcttcaagcaggtgagagctctgatctcgggtgaggccagtgacaggtgggagtctgagaccataggaggaaaatgcagactctggcctgtaaaatccgtaaggaatcggcaggttagagggatattgctggaaaaacctgtagtgatcgtatgtggctggagatggagccaggtgcttagggatcggccccgggtgaggcaggaagtgtctcgggtcttgggttccgtagactgacagcaggggtgcgtcacactcaggcgagctcccagccagcaggtaaggcgagtagatggtggccagcccgtgctctgtgtaaaagtgaggcgggtactctgggattgtggggtgcatgtaaggggaaatggccccaagcccctttgtagatgagattttatgtggaaactctggtggaaggaaaggtgagccggctttccaggggtagccaggagtgtggaaggccgacttggtgtggaaagacacggccttggcagtggggttgtgtaaagccagtgtctcgggcgcctcggcgttgtctggccccttgagtctgtgctcgccgactggaacaaatgcagaaggccgagctgcgccttccagagcaggctgggcaccgagggcggcttccggagctgggctcttgcagggtgatgccctgtggagggctggcttctgtcccaggcacctgtgggttccccgggcttgcagctccaggttttccttgatgtcttccctggcagagctgtgctgaagcttcgagtcgaaggcagagagtccatttgcgacagacttggaagaggctggcttcgccgtggcatcgggctggttggtttgcttggggtctagtgagttagatttagggcacttgggaactcgatcctgctctgatactaaagtaatcgagtttttacaaagaccatacttcatgtgattaaaaagatgtgacttctcattgcaagtaaagggacattggaaacatttatacttgaagggctttcctggaggcctggggatgtaatgtggcttttttggcttccgctctttgaggagactcattttcctccttatgccttggactctggctgtccaggtggcgtgatcactgtcgacgccgcgtgcacttcgtggtttctaaagaggcacctcccgctttgctttctttcccgatcacttctatcagaagccagctctgcgtgctgagggtctggcgagagcctccgtcatctggcggctgggagctgtaataaagagcagtcttggtgtcaggacagcgagtgaggggtcggcgagaagccggcctcggctcgccacagtgccacaggatccctgaagcagaacccctgaagggctgaaactgcctgctcctgaggggagcagctgccggtcacagaagcagccctgccctacccttggtaacctggctgctgactccccaccgtgttttctgttttctgagtctgatctgaaagagtcacctcggggcctagaggtggagtgtggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacacagagcgtgggctggccaccgtctacttgctcctacctgctggctgggagctctcccaagtgctgtgcgcccctgccgtcggcctgtagaacccaagaccatggatgctgctgcctcccctggggccgatccctaagcactcgtggcagtttctgcccactttagccacgtcgttggtgtattctagtgtgcttgtttaaaaatgaagaacattcgaacacaagactctaccctactgcttctaaagtcagctttatcattaagtagcatttatgttgtctcagatatgaatacaaatgctatatttatgttgacttaaatggttgaaatactgttggtgaatttgtacatcctgtgagtgacagcagcattgtgagacatgctttcacggtcacccggttcctgctggccaggaggcatggccagcagcgcctgcccgtccagatgcaccaccaaatggaagaaccaaagctttgccacactcctgcccgagaggagaccagagtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaaggctgtttttctttttttgagacagagtttctcccttgttgcccagtctggagtgccatggcgcaatctcagctcactgcaacctccgcctcctgggttcaagcgattctcctgcctcagcctcccgagtagctggaattacaggcgcccaccaccatgcccagctaattttttttgtatttttagtagagacggggttttgccatgtgggccaggctggtctcgagctcctgacctcaggtgatccacctgccttagcctcccaaagtgctgggattagaggcgtgagccaccgcacccgtcccagaacaaaggctttgagagtctgggactgtccacctggcagctgggcctggagcgactcaagcagcaactgtgcctgggagacagggtgagtgggagatggggtggaggtgcaatggatcaaggctaagcactttaattcgtattaaaaatgtaaaaaagaaaaggtctttagggtctaaatattttcaaacagcttaaaaataaagttaaatgacccaaatgcctatcagtgatagactgaataaagaaaatgcggcacatatacaccatggaatactgtgcagccataaaaaggaacgcgatcatgtccttcgcagggagaaatggatggagctggaagccagcatcctcagcaaactaacgcaggaagagaaaaccaaacgtgcatggtctcacccataagtgggagctgaacagtgaaaacacatggacacagggaggggaacatcacacaccagggcctgtttaggggtgggggtcggggggagggagagcattaagacaaatagctaatgcatgcagggcttaaaacctagatgatcggttgatgggtacagtaaaccaccatggcacacatttacctgtgtaacctacacgttctgcacttgtgtcctggaacttaaagtataataaaaaaaaaatacattaaagtaaagttaaatggagggctgggggccgtggctcatgcctgtaatcccagcactttgggaggccgaggtgggaggatcccttgagcccaggagattgaggctgcagggagctgtcatcccaccaccgcactgcagcctggtgggcaacagaatgagaccctgcctcaaaaaaaagctaaatggaaatgacttaagaaaactgtttcaactgcagtattttttttaaggaatgggcagatgtgcccattcttgagtctgtgaggttttatgtgtagacatcagggtggctaaaagtcaagtgaaaagccgccccttgaaaatagagcaacgtgtgtgggagcctaggaggcagctgtccctgaagcaaggcgccacccctcctccctgcacccgtgtccttcctcccacacgccaggggccaggggtggtggctgggctttcatatggctgccccgaactctggggaagtgctctgattttgttctcagcaaactggtttctctactgatttattcatatttctttctttctttcttttttgagacggagttttggtcttgttgcccaggctggagggcagtggtgcgatctcggttcactgcaacctctgcctcctgggttcaagagattctcctgcctcagcctccctagtagctgggattacaggtgcctaccaccacgcccagctaatttttttgtaattttagtagagatggggtttcactatgttggcccggctggtcttgaactcctgacctcaggcgatctgcccgcctcagcctcccaaagtgctgggattacaggcatgagccaccgtgcctggctcatttatttataattcttaaaaacacaaccacccttccccctacaaactgcctctattaacatactttaagttctttaagacatttatttactaagaagtggtttgggtagaaaaggggctctgctgacctgccaccttcgctgtgatgagtttctgtgtagcagggacagcgaggcacggtttggatgaggacaagatgtttgttaccctacaaccagggagggtgtcgggtgacaccctgggctcagaccccgcgctcagcacccgtctcccaccgtgggctgccacagaagctacaaggcaccgggtcaaggccaagcaaatgaaacacgtaatgatagctctgtctttctaatttccccctattagaagaaagaacgtgaaataattctttatgggctcagtccctaccgtgtggggcagacctgctctgggtgatgaaagcagtttccctgcctcccttcaggaagtagagaagccgggtgcctggttccagccaaacgctgggccagccagctcagtcagtggggcctgtgccggcatgcctcgccgcgctccctggttctgaaggcgtgagaacctctgcaagtcaggttcccatgattgtataggatgtgttacggcagggatctgaaagctgatgatttcatcactagctggaagcatcaggatcgaaacgatgacagttgcaaaatgttcatcaagtgagagctgcgtcctcgcgagaccgaaacgccgcctctagcacctgaaacacaagccctcagaggagcagatgattccctcaggatttaagaaaattgaggacttcagttttcgaagccgcattatttcacattgctgatacctctagcgcctgaaacacaagcgctcagaggagcaaatgattccctcaggatttaagaaaatgaggacttcagttttcgaagcagcattatttcacattgctgatacttttaggcaaaaaaaaaaacaaaacaaaacaaaaccaaaaaacaaaaaaacaaaaaaacccacaaaacccgtgttggttagattttctcaaaagctttacaacaggcaggttacgtgtaagctctgctgttgcccaaaatagtaattagggaaataattgcttttaaatgaatatgtctgttttctagtcagatttgcccttttgttctttgatcagttagttcacgtaagcgggtgtggcagggaggaagcccctggtggtgagagtgtttggagctcaattgctcgaagggaattggtgtcgatatggagtctcgggcagtggttttagtaaccttggataaaccgacctctcaggcttgcacaatttgctaattaaaacagggagcacagctgcttcagttgtaagccgggcgtaggtcacctgatctgtaaaactacaatagtgtcagagaagtaagtgggataacattgttgctttggtaagctttcaaatgatgatgatgtcagcctgtgagttctgtgtcctgcttaagtgaggtttataaggatgaagaaaccaaacccgacggccagtacctcaggctgtcacagctgtctgtgggcacagcgtttgaaatagtctctgtgtggtcagtttctaccagcccgactttgtactctggcagctgctggtgttaaatattcccaaaagagtatgttgttgcccaaacagtgtaacccagaaatctagctgtttacagtaatttggatttgtatttagaggtgcagtttttctctagaggggataaagaagtgcggagcgtctttctctcctgggggaggtgtgtttccattttagttaataacatgcccggagagctgtctgtctgtctgttaataaagcagagtctcattcattatctgctttcatttgagaactgcagtgctagcgtgttttacagtgaagacctcggtgtgatcctgaaggagggtttcatcctcctctcatttcccactggatcggcaggaagcgttagcagggtggacatgccacagagcttccagatctggatcaaaggtggctgttgctgaaatacttatgcagagtcttccctgactgctgctggctaatgtgtgccctcttctccaacacacctcctccgagcctggcctggcacaaagccttctttctccaagttatttcagatcaagcagccaatgtagacagtgtctacactaaagggcgtaagaacagtggggtgcagtggcttcaaacatgctcaggatccagctgagctttcaccaggcttttcttgccatatttacagatgccactctgtgcctttctaaatattttaaatgttgtgtgctcagccgatgcacttggcttctggaaagtgcgctgagctgagagctcgcttctcttcctgctcaacgtgcactgggccgggtgttggggcgtagctgcccacacagacagtgctttgaagagtgagtggtttcggttggccatggggttgtgtctaaattgccaatatactgtctttccaaaggttcctaagtgtggacagttaatgcagcagacagttgttagggtaatagtgagaagttgggatgcttaacaagcttctaaggagtttgaactttgaaaaatagacaagagaaagagttcttaaaaaaaaaaactttgataggacacagcggaagtaattacagtttaactttatgggacgtttctgtgacaggctgggtaactatgcttgtcatgcgtcctaacctgtgccctgagattgtgctgtaatgttccttttggtggtgtccagctgtctggcaaggagcctgctcggctggagcattgtgaagggcatgctgtaattacaatattgtgatgtggcgttgttgcataactcaaggacacaccattgtcgcctacccactgtgatgtcgcaagaacgagatttgtgagttttactccaattgagcttttccagtgattgactgccactccctcccagcctttcggttctttaaaatgaaagataaacctcaggacaaccaagacctggggaaaagacagtctttgggaatgtaatttggaagaatggatccagaaaaacaaccaggggctcttaactctagtttcggcaggagatcccgagttacagacctgagctcgtaaacaaacgctcaccactttacagtcgccgcctcatcctgaaactccggtcagaaatgctggaaggcctttgctaatgcgcagtgaaaattaggggcacagatgtggacggactgtgcttggtcagtaattgttctcctccaaatcaagtttatgagaaatttcatataaggaaaaaaacccttttgtatctgtgtctatatgtacagaagaccttaacaaccaaacagaaacttaacccctttggtttggttttgttttcgaaagcttatgcccaattttaaacttcatgtaagcttatgtacttattttaaactttaaaactattaaaagttaaactagatagtaaattcggcactgtctaatgtgcatacaccacaaacatataaccctaaattcagctgtgtctaatgtgtatacaccacacatatatataaccctaaattcagcctgatgtacttataccacacatatataaccctaaattcagcctaatgtacatataccacacacacatatatataaccctaaattcagcctaatgtacatacaccacacatatatataaccctaaattcagccctaatgtacatacaccacacatatataaccctaaattcagcctaatgtacatacaccacacatatatataaccctaaattcagccctaatgtacatacaccacacatataaccctaaattcaccctaatgtacatacaccacacatatatatatgacccttacctcttgttagcatttattgtagtttgtttttgaggttaggagcagttaagcaataatatgaatttgtgttggtttaacttttatgaattttagggcagaacaaggagttaatttccagataagcttgttcatgttcttagaataaagtgtcagcctcattagaagttttgtaatcgtggtctgcatcccagccatgcacctgctgggtcctgagtaatcctcggagcccagagcaaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgggaaaggaggtgggatgagctggtgtcaggcccttggatgagcctgaggctgcagggcagaggctgcagggctgtggcatagggacgagctggccaggacagacaaactggtttttttttttttttttttttttttttttgagacagagtttcactgttgctgcccaggctggagtgcaatggcatgatcttggctcactgcgtttctcctgcctcagcctcccgagtagctgggactacaggcgcctgccaccacgcccggctaattttttgtatttttagtagagatggggtttcaccgtgttagccaggatggtcttgatctcctgaccttgtgatccacccacgtcggcctcccaaagtgcttggattacaggtgtgagccactgcacccggtctgtttttttgtttttgttatttttttccttaagacttaagattttacatggctttgcgtttacttttatatttaattccttttttttttcttttgagacagggtcttgccctgtcacccaagctggagtgcagtggtgcgatcacggttcactgtagcctcaacctcctggactcgagtgatcctcccgcctcagtctccccagtagctgggactacaggcacggtcactatgcctggagaattttttgtagagacagggttttgccatgtttcctaggatggtttaataccttaaaattttttttggtggcttttgtccattgagacatccatatactttatgaagtcaaaaagagttatgtaagtcttatgacaaaaaacagcagttccctgtccctcttacctattcctggatagcaaactatcccaaacttagtggcttaaaacaagcaccgttttattacgtcttaggatatattgtgtcaggagtttgtggagggcctggccgagtgctgcttctgtttcatggacactgactgaggtggctccgtgggagaaagctggcaggtgactggtctggagggtccaggacagctttactcacctgccttctgtcctggaggggcagctggaatcctgagatcagctggaacctcatcctcacttagtagcacttcagaggcctccctagcagggtggtcagctgtatgatggctcaggacttcaagagagcaaggcggaaggttccagtcctccagaaggctgggccgcagattgtcagggtgtcccttctgtcacctttctctgctgaggcagcctcgtgctgcccagatgcaaggcgggagccgagggctccacctctcagcggcaggagtgccaggtgtctgcgctacgactccctctgcccggaagccccaccttggcctttcctaagctgagtgttctgacccttgccatggagggtccagtgaggcctttgagaatctgtgtaccttccaccctctaccctgctcctgagagtctctgtccctggtcctccttgggagctgagacggcagggagggagcttatcccagcgcctggctgggtgtttacctcctcgattccagccttactgatctgttggtggttctgtgccctctctccccctctctcccttctccactcctggtcgaggtgttgtttggtggcttcccttcatggaagatgggaatttgcctctctttgccccttctgcccccatgtctgccttccccgtcacccagggggttttgcctgcctctctcttgcactggaaggcctgctgctcggatcccatgtcgtctttctcttgagttaatcatttagtttgacatgaggcacacaccttttataggctcttgagaaagtgcaagagagatttttttggaggtcttgaattattgaaaatgtttttatctactcttcaacctcactgatagtttggctgagtctagaatttcaggccagaaatcatttaccttcagatttttgcaagtgttcttcattttctttctttcttttttttttttttttttgagatggaatctcgctctgtcacccaggctggagtgcagtggcgcgatctcggctcactgcaaactccacctcccatgttcacgccattctcttgcctcagcctcccaagtagctgggactacaggcgccctccaccacgtccggctgattttttgtatttttagtagagacggggtttcaccgtgttagccaggatggtctcgatctcctgacctcgtgatccgcccgcctcggcctcccaaagtgctaggattacaggtgtgagccaccacacccggccgcaagtgttctctattttctctagcttctagtactgtggttgagaaccttgatgccattctgattcctgattctttctctcttaacattttagtgtgaaaattttcaaaatacagacaagttgtaaggatgctccagtgaactctcatatgcccaacggtggggttctccagttaacacagctgtctgtgttcccttcccttcccctccctgtccagcttacttacccttcccttcccctcccctcccctccccgtccagcttacatacccttcccttcccctcgccgtccagcttacttatcattcccttcccctccccgtccagcttatatacccttcctttcccctccccatccagcttacatacccttcccttcccctccccgtccagcttacttacccttcccttcccctcaccatccagcttacttacccttcccttcccctcaccatccagcttacttacccttcccttcccctccccgtccagcttacttacccttcccttcccctccccgtccagcttacttacccttcccttcccctccccatccagcttaatcgtcttgctgcatttcaggtcagttgcagacatcagtatgctttgccccaaacacttttcaggcatattcttattagtttatgattcttctttcaaaggtaaggtttacattcagtgaagggcacaggtcttaagaggatcatttaacgagttttgacaaatgtgttctcccattatggccccagagagttccgtcacagcagtgccacccttccccacccagaccgtggcaactgcaggctgatacttttccaccatggattagttttatgtgttgtagaattttatgtcagtagtgattcctgatttttatggacagctgtttctcacctgcaggttctttcctttatcctcagtagtcttagttttcttaactttatatttcaacacttctgttaagtacttggtttctgattttggtttccatgagctctgttttgttctgagtgttccttttgtagcatctcattctcatgcagtactttcagtagcttttcttatctaaggattttagtgatagctttcttttagtggggagtggaggagtgggggtggatgttctccgtgtgtgtgtgtgtgtgtgtgtgtgtgtgtttaaagacctggggtcttgctgtgttacccaggctggacttgaactccgggtctcaagtgcttctcctgcctcagcctcccgggtagctgggactgcaggagcgccatgccatgcctggtgccctccctgcatcgtcagtgtggctgcctgccttccagggcctctgctgagcacctcggagagtcagccctgtctcctgccccagtgctccttgggttaggcctaccctgcccctccccacagagttctctggtgccacagatctggagctttttagggacctgtcctgtggatcagggggagtctgagttgcctccctccaggggagggctgggcttcttggtctgaggcatttcctgctgtccctgcacttccaggctcctccgtggtcctggtgctgccttccctgcccttcctcttctaccctgtagcttatttcttgaaaaaagaaaatggtccgtttctgctgtttttagtgggattttacccgctattttttacatgttcaaccccctgtgttactcagaattcttgcgattaggtttttgaccaaatcttaggaaccgtcatgggggtggcagctgatgtttcttgcgtgttgatggtgtggggcaccgtgccaggtgcatcacctgcactggtccatttactcagaagcaccacgcacctggcctgtggagtccccccacccacaggtcgggaacatggccgaggtacccagcccagagggcgatgagcagagttacaccagaggtggggggtgcttccctgggtggggaaggaggggtacctggggtggtggctgctcttgggggtaagcaccggtgccagtgtgtgttggggggtgccagggacccaggcaggtgctggcgccgcggcctctgtgtcagggcctctttccctaggggcacacaggctggaagtgcagtcctggttgagctttcctagtttccaggtcgggggtgaggcacaggacatggccggctcggccccttcctctccatcctgtccagctcagccccttcctgtccatcttgtgcggcccagccccttcctctccgtccatcctgtccggcctggccccttcctctctgtcctgtctggcctggccccttcctctctgtccatcctgtctggctcggccccttcctctccgtcctgtccagcttggccccttcctctccatcttgtccggcccggccccttcctctccatctcgtctggcccggccccttcctctccgtctgtcctgtccggcccggccccttcctctccgtcctgtccagctcagccccttcctgtccatcttgtgtggcccagccccttcctctccgtctgtcctgtctggcctggccccttgctctccctccgtcctgtccggctcagccctttcctctccgtcctgcccagcccaccccggtcccttccgcagcagcatcctctccagtgcactgtgtgctgggactcaagtcttggctcttccatcttcaccctttgtgacttggggcagcaattgctgacctccctgggcctcggtcttcctgtccgtgaaagggacttgtgagcatctctcacagaacacctgtgatgaaggaagggcgtcacatcttggatcttcttaaaatacaagattgtttctgttttaatcctttgtgttccttgtgaggtgctgcatccagaggaaaggagaaaggaaatgaaaactctgcggaaaatccacaggcctggcatcagcctcccagtctgattttgacgcggctgtaggggagacacagcaacattctatcccccgagggcacagcttcaggaacggctccgggccggagggcacctctcgcctggctgtgttgtgtctcagggctctgcgcttctaaagggactcaggccagtgggcagaactgtgggatgggactgggaggcttagggggtgagggtgtaagccctgtgcctccctccacgtgctgcgtccggcatgccacgtcccctcgtccagccctctgctgccccctccacgcgctgcgtcctctgtgctgtgtcctcttgtccagccctctgctgccccctccacgtgctgcgtccagcgtgccgtgtcctctcgtccagccctctgctgccccctccatgcgctgtgtcccatgtgccgtgtcctctcgtccagccctctgctgcccgctgctctctttgggacttccattgtttccccttccccttcctttcctggttttcttccctagtgaggtgcccttcctgctgctgcagggccctgctgtggcctctgccttccgtccctggcggtagtgagactggctgagacccaggggaagcttggagactgtcctagatttcggagatggtggtacacaggcttgctggcttgggttagggctctaggccctgccttcgggttgtctggaagccgccagccaggcctggacacctctctgcccccgtcacctcggagcagcagcccaggagcgggtcacagcccttcccctgtgttacatggtcacctgcctgagaacccctgcaggcccctgtgttttgggaagttgatttaactgaacagagcgcagctgagaaggggcgcctccctccccacccaccctcattgcctgggaccgcgtgtccaggagccgggcctcgggtgtctggtctctgggccacacaggctaacatggccaagcccagctgcacccccggggtcctcacccgccatgtgcctgtggtcgtggccaaggtctgggcccaacctgctctgggcgctgtgggcaccgctcagccattttctacaggtggccgaggagacatttggtttctcattaaaaagaaacaggccgggcgtggtggctcacgcctgtaatcccagcactttgggaggccaaggtgggcggatcatgaggtcaggagatcgagaccatcttgtctaacacagtgaaaccccgtctctactaaaaatacacaaaaaattagctgggcgtggtggtgggtgcctgtaatcccaactactcgggaggctgaggcaggagaatggtgtgaacctgggaggcggagcttgcagtgagccgagatcatgccactgtattccagcctgggcaacagagcgagactccatgtcaaagaaaaaaaaaaaaaaaaaaaaaaagaaacaaccctgagaacatcagtggggttttactgactgtgtcagacaactcagcgatgcagagaaatgaaagtggagttgatttggctcttgtggtgagatacagccaaggtgtatgagagaatttggggaaagctttctttctggacatttgttgacgttgatgagtagtggagggctttatttgtaagttgaagtctgagatttgtcatgccaatacctaaattttaatttgtttgtacaaataacgccacaatttaattcttttttctttttgagacagagtcttgctctgtcacccaggctggagtgcagtagtgcgatctccgcctcccgagttcaagtcattctcctgcctcagcctcccgaatagctgggatcacagttgcgtggtaccacgcctggctagtattttgtatttttagtagagatggggtttcatcatgttagccaggatggtcttgatctcctgacctcgtgatccaccctcctcggcctcccaaagtgctgggattactgggattacaggcgtgagccaccgggccgggcccacgatttgaatttttatggaactggggctaacttaattttttcagacgagtgggagtagagcaaacggcccctgtctgttgcccctttttcctaccaaggcccctccaggctgtctcttgcctggtgagtgtgaggagatgggtgggcgcggccctgtgggatggtgctctgtggcagggctggcagtttctgggtgtgtggcctgtgggtagcctttgtactgggcgcacagtccccggctcctcccttccaacaccttcgccctgagcggcctcggaaatggggcttctggcggctctgcaggcaccgtcagagtcagagggagggcgagcggcttttggtttctgtttaaacagcgtcctgtcgctccctcctctcctgtgcggattggcgctgcggcttctgtgttgagagggaaacttgaaaccctgagctatgtatggcttgttttgtctttgattgggaaacccaattcaggtttgtgaacttgggccaagtttaagaattcccacagttttcttcagctcctctcctccctgaaccccgacagcgaggtgtcttacgcttcggcattctcactcgcctgactcagacttgttagttttccagagcaactcatgtggccgccgtctagggagtttattcagagggtgcctctacatgcacagcagccaggtacagaagtcatgagttaaatcgcacaaggacaagtaaaatgaaaaaaattagcactcagatcttcttttttttcatgctacaaaataacagtgaaaaacctaacgatgaaaatagatgcgaacagacaaaaggtcaatgggcttgatcccttctcatcctctctcctgtgtctcctggaggcttctgcacctctgtgtcttcccccgctctgctgcgtcttctccacctcgatgtccccctctgcctgctgcgtcttctccacctcgatgtccccctctgcctgctgcgtcttctccacctcgatgtccccctctgcctgctgcgtcttctccacctcgatgtccccctctgtctgctgcgtcttctccacctcgatgtccccctctgcctgctgcgtcttctccacctcgatgtccccctctgcctgctgcgtcttctccacctcgatgtccccctctgcctgctgcgtcttctcacctcgatgtccccctctgcctgctgcgtcttctccacctcgatgttcccctctgcctgctgcgtcttctccatctcgatgtccccctctgcctgctgcgtcttctcacctcgatgtccccctctgcctgctgcgtcttctccacctcaatgtcccccgctctgctgcgtcttctccacctcgatgtccccctctgcctgctgcgtcttctccacctcgatgtccccctctgtctgctgcgtcggggctgcctaccgggcttggtcttcagggccactgtttctcctcagctaagtcctgagagtcacatttccatccattgcagtgaaatcttttccttcaggtatttccagaccttggttttggccccttttcatatcttccttgtttcctcgctgtggttttcatttcccctttcgtctccttaacctgttttttgatggtgtctttttaggttatctcaagttcatttcaagctctgaaagtaggaagtaaagtaagaaccgcgtggcactagcaatcactaggcattgttccaagcacacggataaactgagaatcctcgtggtcgccccgggggtgggactgccattgtccagagagacctgcttttgcctgtggtgccacacgggtccctctcacaggatgcgaccatggtggctttgcgtcatgtcacctcagccaggcaggaccttctgctggaacccccttccctggtagtcctcggagagggctgtgcacaatctggaggcagaagcgaagcagtagcccccgtgcgcggcagctcttgaggctgtgctgctgttggctgtgctgttgttggctgtgctgttgttggctgttttgctgttggctgtgctgttgttgcctgtgctgctgttggctgtgctgctgttggctgtgctgctgttggctgtgctgctgttggctgtgctgttgttggctgtgctgttgttggctgtgctgttgttggctgtgctgctgttggctgtgctgtgctgctgttggctgtgctgctgttggctgtgctgctgttggctgtgttgttgttggctgtgctgttgttggctgtgctgttgttgcctgtgctgctgttggctgtgctgctgttggctgtgctgttgttggctgtgctgctgttggctgtgctgctgttggctgtgctgttgttggctgtgttgttgttggctgtgctgctgttggctgtgctgttgttggctgtgctcttctgctgttggctgtgctgttgttggctgtgctgttgttggctgtcctgttgttggctgtcctgttgttggctgtgctgttgttggctgtgctgttgttggctgtgctgttggctgtgctgttgttggctgtgctgttttgctgttggctgtgctgttgttggctgtgctgttgttggctgtgctgttttgctgttggctgtgctgttgttggctgtgctgttgttagctgtgctgttgttggctgtgctgttgttggctgtgctgctgttggctgtcctgttgttggctgtgctgttgttggctgtgctgttttgctgttggctgtgctgttgttggctgtgctgttgttggttgtgtgtgctgaccccggaccccctacagtatggctgtgcatggactggtgatttggcccccatggcctcatcagccctgatccatccctgcattgaattcgtatggggcttgtggtgagtctggactgactcagctttctaaaagctgaaaagcaaaagttaataggtctgcagagataaatggacagacccggtatcctcctgagagctcaaaacacctcccaattattgataactaaatatgtagtggagatatagatatgtataaaacgcacattacatactgtgtgtgcacatacaatatttcaacagcagaggcgactggcatgattccataattgatacagaaccgtgtagctagccgttggagaatacacatttgtaggcacctgaggaacattcacagatattacacagccaggccataaaacaagtctcgagacatttcagagactcactggcggacagatggtattccatgctcacaaagtaatgaaattaaaaactggatacagaataataaaggaaaggtgataatttttagttagaagatatacaaatgtgtaaatcacatgagtcaagtctcaggaggttttaaaataaaaagttaaaaaagtttaaaaataaaaataaacagtcacaaaattattctatctaaaattttgggatgcagctaaggaaacttaaacctttaaacaggtgtgacgaaattgtggcctgcaggcccagtggggcctcagcctgtttctgtacagctttggagccaagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaaaggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcattaagtgtacagttcagtggcttgtaacgcatttgcagagttttgcagccatcgccacagtcagttgtagaacattttaccccacgctccttcgctgtcatccccaacccccccgacagatggataaaccccccctcctagacaccacagatgggttctctgtgtctacccattctggacatttcctgtgaatggaaccgtgccccctgtggtcctctgtggtggctccttgccccgagcgtggcgttggcgtggtccgtgggcgatgcagcccccagcagtgctccttttcttttccttgttgaagcctgttccatcgtgtggcatcttagtcagctcaggctgtggaaacaagtcaccacagatgggggctcaagcagcacaaatgtatccctcacagttctggaggctgggtgtccaaggtcgaggtgccagcaggctcggcagcaggctcggtttcttccgggttttcctgggcctgcaggcgctgccttcctgctgcgtgctcgccgttcggtctgtgtcttggtgtccttgtttcctcttcttaggcggacactggtcatagcagatccgggccccacttgcgtggcctcattttaccttacgcatctctaagggccacatctccagatacaggcactcgggggcactggggttaagacttcagtatgtggatttcagggagacagaattcagcccacgacgtacatggaggccgcattttatttatccatctgtcagttggtagacgtttgggttgtttcccactgtaggctgctgtgaataaagcattcgtgtgtgagtttttgtgtggatgtggtttttgtcttgggtataggcctgggcttggagcataggactgttcggaaagttaagggaatgaacgtattcagagctcagaaccgtgtctggcttgcgatgcgttctgttttgaggttagtgatgatgatggagagcggctcccgaggacgagagctcgtgatggagagtgcctctttatgcccgatgtgaatgtggctactcagctttctctctctctttttttttaaattaatttattttgtcgagacaggttcttgctctgttgcccaggctggagtgcagtggtgtgatcatagctcactgcatccttgacctcttgggcgcaagtgatcctctgacctcagcctcctgagtagctggaaccacaggcatgtgccaccacgcccagctaattgtcgtattttttttctttttctttttttgtaagggtagggttttgccatgtagctggtctcaaagtcctgggcttaagcagtccacctgtctcagcttcctaaggtgctgggattacaggcttgagccactgcatccagcaacaccccccctccttttttttttctgtttttgagtcagggtcttgctctgttgcccaggctggagtgcagtggctcactcacggctcactgtagctttgaactcatgggctagatccatcccctgacctcagcctcacaagtagctgagactacaggtgtttgccagcacacccagctcattttttctttttttttttgtagagacggtctcaccatctagcccaggttggtcttgaactcctcgcctcaaatgatcctctcatcttggcctcccaaagtattgcgattacaggcatgagccactgttaatggccccagctttctttgggttcgtgttttctcagtgtattcttttctgtcttttaatttttttatattcttgcattttagatgtatgttgagtaaaaatctaccgtatgtgattttaagctggtgagtttagtccatttactttactgacatgtttgggtgtctttgtcttattatatgaattttgctttttcagatttttttttgtttttaaaagttgtggttcctattgggcccccaacccagtcccattccacatcttcttccttgttggtttggaatcatctattctgtttcctgtgtttcttcaggggtcgtattcagcttgtaccacgaatattcagagccaacagccagcttcttagcctaccctccaagtaacacacagcacaccctgacctcgatcactttccatctgacatatttgacattgttgagtttttagttcttcttgtttaacattagacattacaggttgagcaccctgaatccgaaaatccaaaaccgaaaactttttgaatgctgagttgacactctgcaggtgatgggctgcagtcaaaacacaggtaaacaacacacagttgattcagcaccccaaggggaaaaagatcctcccagcccccttcagctttgataaatcctttccacataagaccaggttccctcatgcaagcacgtccacaaagggcgatgaaatgtcgggtgcaggccggacgcaggcgctgcaggctccttatgaggctccacatgggcgagacctgtgcgcaccgctcgtgtgtttgcgtatcctctgctctgtggtgtacagatactgttgaaaacatcagaaaggcctgcaggttacttgtatgggggtgtacagatactgttgaaaatgtcagaaaggcctgcaggttacttgtatgggtaacagtggtcagaaaaggggcaagcattcacgtttgcatgtcgcacagaaagtcagactgctggggggagctgggcagcagtgtaagagcacggtgctggagtgagtgccagagatgacctaagaaacaggaggaatggttgacgttctgtgctggaaacgatgaccagaaaaaccctgcacaaagctacacgtgaaatttctatcacgtattgaaagagtggatctgtcagcatcgcagtggacacaagccacttaacagtgccaatcacaagacaagcaaagctctgtgtaaaggccctgatcgcattcatgaagctctgtccttgggactcatcatctacgaaaggccacacctcctaacaccgtgctcttgggagtgaggatttcagcaggaattctggggaacagaagcattggggcgtcgcatctccctgtggccttcctccctgtggccttcctccgcctgccagctgccccctcaccctgctgtccacctcacggacccctcttcgccccatatgggccactttggcccccaccaccccttcctggatgtgcagaccctatgcggtgccacctgatgcttcaagactgaattttccagaggggcagggaaaggtgtttgcttttttttttttttttttttttttttttttttttttaattttttagagccagggtcactctgttgctcacgctggagtgagtgccatggtgtagtcgcggctcactgcagtcttggcctcctggactaaagcgatccttccacctcagcctcccaagtcactgtggcactatgggtgcatgctaccgtgcccggctaattttttttatcttttgaagagatgggatctcactatgttgcccaggctggtcacgaactcctgggctcacgtgatctactcacctcggcctcctgaagggctgggattacaggtgtgagccactgtgcctggccaggtgtttgctcttaaaaagtcatttctctctttctgtgtgtatttgtgttttgaggtaaaatttcacataacataaaaataaccattaactttaaagtgaaaaactcagagcatttagtacatacccaatgttgcacagctattacttctgtctacttttaacacatttttgtcaccgaaaaaatactctggtgtccattcacatagtcatgacacatcacgacacatgactgtattcccaacccctggcacctgccaggctgttttctgcctctacgtttacttattctgagaattttatacacatggagtctgcaatgcgtgaccctttgtgcctggttcatctgtattgtagcatgtgtcaggccttcatttgtttttatggctgaataatattgctttgtatgggtagactccccccccactttttttttttttttttttttttttgtagagacagggtctcaccatctagcccaggttggtcttgaactcctggcctcaaatgatcctctcatcttggcctcccaaagtattgtgattacaggcatgagcctgaatctgaaaaagcaaaattcatatagtaagacaaagacacccaaacatgtcagtgaagtaaatggactaaactcaccagcttaaaatcatatggtagaattttactcaacatacatctaaaatgcaagaatataaaaagattaaaaggaaagacagaaaagaatatgctgagaaaacactaaccaaaagaaagctggggccagtaacagtggcttaatgcctgtaatcacaatactttgggaggccaagatgagaggatcatttgaggcgaggagttcaagaccaacctgggctagatggtgagaccctgtctctacaaagaaaaaaagaaaaaaaacagacgccccaatgcttgcgttccccaaaattcctgctgaaatcctgactcccaagggcacagtgttaggtgtggcctttcgtagatgatgagtcacagggacagagcttgatgaatgctatcagggcccttacacagttgacggacacttaagttttcccaccttttggcccttgtgaagaatgcttctgtgaacgtttgcgtacaagtgtctgtttgaatccctgtcttccccttttttgggtgcgcatccagggcgggatcgctggaccgcgtgcggaccctcgctgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcggtgcgcatccagggcgggatcgctggaccgcgtgcggaccctcggtgtgttactgaggcgtccccaagctgtttccacagacgctgtgctgccctgcattcccaccagcaaggcgcagagcttctggtttctccatgtcctcaccaacacctgtgttgttcttttttaaaaaattataatcagcctcgtaggtgtgagggggtatcttgtgattttgatttgaatttttcttaatgacgaatgacactgagcatcttttcatgtgctccttggttgtttgtgtatttctctggataaatgtctagtcaagtcctttgaccatttttaaattggattgtttgtccttttgttgttgagttgtaaagctgtttgtatcttctggatattaaactcttatcagatatatcatttgcaagtattttctcccattctgttggttgtctttttttttcttttgataatgtctttgtattgtgtcgtgtttaatgtaaacatttcaccattgttttaattccctcttttcagttcttttctgtgtgtgtgcagtttttgggtgtgtgtgatgtgtacatacacacatgcacatatacaggtgtctaaaaagtattttgtttttttgttttaaatatttgacacttttaaattggagttgagattctgtatggagtaacgtattgttgaatgacaggaaagtatgaagcttgtcggagtgttattacttggcatagccacaggagccatacaaatgatacaaccttgctgcttgtgtctcatggtttttttttttttttaatttaatttaatttttttttcattttttttttaaattatactttaagttttagggtacatgtgcacattgtgcaggttagttacatatgtatacatgtgccatgctgctgcactgcacccactaactcgtcatctagcattattttaatttgttttagttttttttttgaaaaagggtcttgctgtgtcactcaggcaggagtacagtggtatgatcacagctcaccgcagccttgacctcccaggctcaagcgatcctcctgcttcagcctcccaagtagctggtgctacaggggcacaccatcatacctggctaacttttgtatttttttgtagagatgggatctccctatgttgtccaggctggtctcgaactcctgggctcaagtgatcctcccgcctcagcctccctaaatgctgggattacgaacatgagccactgtgcccagccagcctttgttgtttttgaaagttgaaattcatgtttttggatcaaagctaagctgtgacatataaacatgaagtgatctagttaggtttggttatacaccatgtgcagaaagcaacctcttcatgaatcttttaatgaacatctttctacctggaagaaaccctttacctactaaacttactttcacaccttcctaattttgttgtcttccgtgtttttgctagctccaggcctattcggcatttaaaataaaatgcaggttggccagtctggctgggcagttctacaggtactacggctggaggatcccagttgacttgaaattcaggttttgcttgtgaaagtagctggctggggcttctgttgatgacagtgctgtgtggacggcctggttcgctgggtgtgcctcacagacacaggacactttttagggttgcttttgaatgtgcctgaggtgaggttcctgtgttttccttgtacttaccttcatattttctgaccctcctgtggatggaaaatcgactgagtgtgtgaagggcctgtcggtgtgaacgggccctgctcagccggtccatggctgtcttaggatcccgcttggtggcgaggagggtgcggctcgtgggtggctgcctggggctaccccgtgtagacttgctgggactttgtctagacaagagaactgctgtcagtggcgcttcctgcggggggatgagtgcggctctcagcgcctctgtggggctgggggtcttgggccgtgaggccggggccaggctgcgtggcaaccctgagtcccaccctcattgtctttgctcggggccccgagaggccatggggagcctgccggctctgtgtcctccccgcactggcttttagggaaagagagtctcgtgggtcatccggcctgccggctctgtgtcctccctacactgacacactggctttcagggaaggggagtcttgtgggtcgtctggcctgccggctctgtgtcctccccgcactggctttcagggaaagagagtctcgtgggtcgtctggcctgccggctctgtgtcctccctacactgacacactggctttcagagaaagggagtctcgtgggtcgtctggcctgccggctctgtgtcctccctacactgacacactggctttcagggaaagggagtcttgtgggtcgtctggcctgccggctctgtgtcctccccgcactggctttcagggaaagagagtctcgtgggtcgtctggcctgccagctctgtgtcctccctacactcacacactggctttcagggagattgggccttgtgtgtcctgttgggtgagcagacacacaagctgtgacttcagggctacggaagttgctctgtggtttccggcactgcagactccaagtgtgagccctgtagtgaggacaaagagtggaggttggagttcagaattgtggacaggctcctgaggaccagcagaggctggaggccagggcttgcccgccgggagtgtggctgtggaaagattccagtccacagtgggggctgctgcccagactcaccctgaataaagtgtcttcagagccacctgtcctgcctgttcatggcagtgacccagaaagattcatcagtgggcggtgagttgggaacagaaagaaaacccttgagataactgggttggagacagggagcaggcttgtcattgtgcactggtgacatggcctttggcctccccagccgtctggcctgggcctcgtggtcctgctcttgggcttcatgtgtccttgggtgtcagctccagcatggcgtcctctgggccctgctgcttctgaagtgcctgtgccagggacactgtcttggggccagtggaggtctgagtatgggggctgggagtcctaggcagtgagtcatggcagaactggcccctgacttcctggttaagcctttaattctcccgaatgcctgtttttgcttctttcaagttgttgtgcttgagccactctgtcattagctgtgggcgttccgagtgccagcgcacagtgttgagcagagcgggtaggagcgccctggcttcagggagggcccccgccccctgcatggcggtcacgctgcgctgagcgtcccctcccctctggtggcctttcgcagtggtggaggggcaggaactgactggctcttttccctgtggtggctgctcgggtggcagtgagcggacagcgagggggacagacacaggtggaaggaaccacggtgggtttcattaacaatgacagtggctcaggagatcctgaggctgattaatttgcaaacagcaattacttgggattgcttgaaaagaaagttctagcttagaacaggaacctgaggagggctggccacactggaatccagtgcccactgtgacagtggagagccagcagacgccactggctttgatggatgatggagagggtcctggtgtcttctgccatttgtggggggtccttgtgtgctgtgtttgcaggcaccatgggtctccctggacggggttcggttccaccccagcgcccttgtcttgtttcatcgcccgtgtccgggctgtgtaagaagcatgtccatttgtcccgagcggagggtctctgccccgcccctgagggaggccaggaggcccttgttggatgctctggcgggcggcactgggacacggccattgcacccggccctggacacagggcggccaccgcatccggccctggacacagggtggccagggacttggcggggggagctcttcagaatctgtcacatgcacgtgaatgctttatggctttggtattcttctgtttaattttagtaaaaccgcggcccgttgcaagaagagtgtgggcgttggcagctttgtcccaggtgctgcagggttggggtggtccctgtcaccgcctgctgctggtgggggtcagctgcacggatgcacggcctcgcaccagcggcagccccagaggccatgcatagggcaggccccggtggtcagggacccacccagtcctgccaggcgttgggcttgggatgtgcggccggctgggggcacacattcatgccgcaggtccccgtgagtctgggccgtgtgcctggcgagccctgaattccacctcacgtcagccgctggttcacgtcagccgctggttcacgtcagctgctggttcacgtcagctgctggtgttgagtgttcgcatgatgcttttctttcttgggggatggatcagtggatggagaaataaagctgtgagggcataaaatcaatgtttgtttatattgataatcatcccttaaactcagatccaggggcgtcaagagacctgagcccggccccggtgtgccgcgcactggccatgtgtccggagagggctgtgattgcggctgtcagccctgtccattggagctgcagcttggtaaatgcacagatggattttgagaaggtttccctctaaagatgtgggagtctttgcacctcaccaagctgtgctggtgtggccgtggcacataccgggctttttacgtctcttctagggagtgagtcggtgggcataggatggctaaggtatgggaattttaatagggaattttctagtaaatggttctgttagtattacagcttattttagaaagtaaggtgctttcatagagaacgtttaaaattattaagaggtagacaattcttttaaaaacctgaaggtcttttttttttttcttttttttgagacagagtctcgctgtcgcccaggctggagtgctggagtgcagtggcgcgatctcggctcactgcaacctccgcctcccaggttcacgccattctcctgcctcagcctcctgagtagctgggactacaggcgcccgccaccttgcccggctaattttttgtatttttagtagagacggggtttcaccgtgttagccaggatggtcttgatctcctgacctcatgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggagggagaagcctctcggtggaggaaccttcacccagagaccagcctgggggtccttggcccagacgggggaggtgggaacatggccttgggttctttcctccttgcagtttgggtgaataatgtgtgatgaggcctaagaggagatttataaagagtataatctctcagtcttagagaaaagtgtttcaaagtatgggttctcagtgtctgtattgaaaaaataaaaaattcagtgaatgggtaggttatttttcgatctgagggttatttctaagcacatgatttatctttagcacgggagggtgatgccccgccatgtctttttagcttagggactgtcttctgccgtgagttggcctctctgcctgtgcacgtgtgttgccggccccggctcagctgtggcagaagtcagtcacctgtggagttatggaagtccaggcggccaccccaggccggggcctcattccgttaagtagggccaggtgtctgtcctctcacgcgtccgaggtggctgccggcgtgcgggtgtgactgtcgatgagagctctgagctgggatatctggtgacggctgcccctgcttggtcttgcggtgtggctggggagaggattactgggtggaatgtagccgtccgccttttgtgttgacctcttgacctcccttttgggaggcttattaatgtcaaaaagtgaagatatgaggatgggatcgtaatttctttgtgttgctttccagtagcccagggaccaagctgtgggaaccaggcctccatgtgctggccccaccgtcctcgtggtgcctgtgtctgtccaggcttagtcctcagatcagctgcttcaccacattggctgcaggctgggtggcagatgcccccaggaggaggagaagcatttcttcccagggctttggcctgtgctgtgtgcctggaacctttaggtgctgtggcttcgcagacccggacgcagcgtggaggccaagcggtgtctgtacaggacccttcagtgatgagggtggccaggctccagccaggtcctagggaaagctctccgagagcgacggcttaagcagttctgaaaaattgcaaatgatctgtgttcttggagaaagaatgggagagaagcactcactcacaataatgttgcacctactgtgtgcgggtagggtgcaggcagtgtggtccagtgtgagcggggagggtgctggttgaggggttagtgctcgggacgcagcctttggacccagtgccctcccaaaactctgctcatcagtgcccctgagctcagcattgacccctggaggaactgggcgccttccctggtctcagactgtaagcctcctcgggaagcagcagttggctcctgatgcagctggcctcagatcctgttgggagagcaggattggtgaggaacctggagaggagtaggaggtgctgcctgatagcagaggtgggtgatgggggcagagagggtagcaggggcccagttcagtcctgtctggttttcacgtggagctttttatagagttgtgcttctcaagcctttcaaatgcctcacagcggcagtccgacgtgcagtcagtgacagctgagtagattaccaccctcaggactaaatgcaaaatcatcttcactgggtgcagcatttacagttttggtgctggaacctcctaaccagtgttcttaggggctgtcttaccagtgaagggagctgcctgctgttgacgctccacaggaggtttgcggcatggctgccatctgtgttgtggcctgggactttcttagagagtgggtaaaagatgagtcatctcttgtgtgatttatcagcttcacttgtgcttccagggctctttgaagcgtctcactttttaatttcatgaagaaacaaatgtagtgcagagaacagaaagctgctgtgtgacctgcgggtgcccagcctgtggggcttcctcatcgcccccatccaggcagatcgagtgccggctctctgtgctctccaggaggtggcctttcacagcagggacgttctgtgctcttattttaacaactgtaagaatctgagcttggtgacagttgggtgacccgggctctgtgtcttcgtgttggccagggtgtgtcatacacctggcctggcctgcgtgcctcacgtgtggtggggatttgtgactgtccccagcaccttgacagagggtccttgactctgcgaccctgcacagtgggtggtggcaggtgggatcttggttcacaggcacaggtggggagagttgctgggccagcgtggctgggtgactttcctgtggaaagagcgggcttggggcttggtgcgtgatcccaccgaggccggggttgtgcttggggcactgggggagagcagagcaggtgatgcatatccgggcgcccaccctagcagcacaggaagggctgggatcaccactccccggggcaccgtggggacagcgggggcctgctcactccccggggcaccgtggggacagcgggggcctgctcactccctggggcaccgtggggacagcgggggcctgcttgtgttgggggtggggctccttgccccccaagggcaggccgagcaccaagtctgtgcttgccccactgtgcagcgttgcaggtgcagcagacatgaggccagctgctgctccctgcaggcagctgagggcctctgggaaggcttctctacaacgtcctgtgggaactggaaacccagatgtcagtggaaccaggtgttctgtccatcactgcctcttacctcctagcaaattcaacactggcgtttttttttctgagcaagttgagctgcatttttgggacaggagccatggctgtgtgtgctggtgctgaagggagggtctgcagggacggccacacggatggctgtgtgtgctggtgctgaagggagggtctgcagggacggccacgcggctctcgggagccgtttcctgcgctcgggctctgcaccggcaggctccacgctgagggtccctccacatccaccccatcgtgggagggaggctcagtgctctgcaggggcctgagcagtcggggagacaccccctgcccacagccaccctctctgggctatgtgggaggtgcccacgtttccacgccttcctcgtggagggtgtggcgggctgtctgtgccgcgggggtactcggctgcactgtgcacagccctcaccgcccagtgccgaaatgggaaggcctgacagggcgatgcggtctgcaccagctacatctgcagaagtccagcacgatgcagtttatgcctggcagtgatgtttgtttttaaaattagtaaaacctcattagttatcagaaggcgtaactatatgatgattttttgtggagggattatttctaccttttgtgcagagaatgcctggatcccttctgccccttggggtcacatattgcagtggggactgtggtgctctgagggttaagttgtttctgtcacctggaggctgctttttcctcaggcaattggcgttcaacaaatgacaggctgtctagagagaagggtttttcaattacatggctggacctgggttgccaaaaggaagcctcctggggtgtgttctatacgcgacatgcatttgctgtgtgtaattggaaccatgagaaaggtttttgttcagagctattggatagtttccttattttaaacctgttgaatctggaaagagttgtttttgaaatttttttctgataataacgttatataaaagtttatggcagaggagtttctgttccacacgcccctccccgagctttgtggtcgcccaggtgcctggctgtcaaggctggcctgtcccttgtgttcagggtcccgagatgtcagagctggcagcccaagtcctcccctttatcccgagcaggagaagcagtcctcactccatttttcaccccagggtatagcagcacctaccaccctgggatgaatcagagccaagaggcttggtttttctgttcttgttaaggaaattgatcatctcacaccctctcaagctgttttactttgtgcaaatcagattcctttctagggacctgcgaggagaaacatcctcagcttctaggactcccggggatgccgtcagcagccaggccttggcagctgccgcttcacctgtgctggcgtgtggggccctgacgtctcttgcgggtgtcatggagcaggattggaggtttctgagcagcaggagggcaggagaaaggccccaggactttgcgctgtggcctggcctggaaggaggctggctgggcccttctggatgcctgtagcagcactgccacctgggcagaggccccagaggccccagaggccgaggcaggctttgttctctgctgctgggactcagccctgcgggagcacagggaggacagctggaagcccagcccctctgtggctctgtccacagctggggacagcagtccagtgtgcacgggccacccacagccctctcaggaactggcctcttctctttaagacagaggagtgcgccaggtgggcctctggctggacctcctaggccatcagttttcccagcaggaagtgctgatcagactgaaggaaggcctgcgtgtgtgtgttggcccagatgcctgttagtggacgctgtgtctgcacagctgtctctgggtggctgattcatcccagcagctgactacgatggtgctaaagagaaccatcttacacggacttggggacagaaacctgggctcccctaccgaggtcaggtcctgggggtgtggtgggatcagctcccccagcacctccgtggcctggggtggggggtctgtgtcctcccttgggggcttctcacagggctgccaagcagtgtccaggtgcatgcgttgggcgtgcaggaggcctgaggccattgtccatgctggccactgccactcgcggttgtctgttgggagtcggtctgtccagtggatgaataaattgggactcagcggtttgcacccagatgcccgaggctatggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtgcgagaaggctcagagtggactttccggggcaaacaactgagggccttttgggcgtcacagatttggtttagttcggatcgaggtaatcatcttgaacccgcttattagagtcagtggctttttctgtctcacagccgccttcttgtttggtttcgcgtctcacatgcattctgtgatcctcactgactttttagaaggaaaatgtttgacatttacaagaagtgagagatactcttgcaaatcatccagcagtttctggtttgcagattgatggcagccctggcctttaccctcagtgcctcctgccggtgatggtgctgccggctctgacctgtgtgaggagggccttggagagcacaggtcccccagggggaggactccgggaggtgctttgcgggagggagtcatggccgagagagggaacgcagagctgccgtgtgtggccgtgcagggccttccacagtgagttgtggggtcctgggggtgagagctgatggtggtctgaccatggtgggaggtggtccggtcctgtagaggcgtggctgccgcagttggggcgggctctgggaatggcgcggtgtctggatgtggaggagtgaggaggagccggccctgagctgcacccaaggagagggctggccatggcgggggcaccacaccggaggacagctcttctgtgggcactgggcttgaagaagctgcagcgcatccaggtggggtgtcctgaggaaaggtggcttggagaggggtgggcccctgcctggagccctggcaggctggggagaccttggtgtctggcagggaccccggaatgtcctgctgctcccccgggcctctgtgtgcagcgccctgcgtcgtggctgggctgagaggaggcagtttccctagcccctcactctggcgaatttcacattcttgataccacggtatctttgaactttctattttgaggaaagttcatttttatgtagttttagtaagtgtataaacgtaataatcttattaaaagtaatcaccatatgtatataaaatacactgtgcagaaacatccatttttattgctgtttatagagaataaaagatccttagatgcaaaaagtcagaggggaaatttgcatataatattcgtagtcctacagttgttgcttatggtgttttgcctaagaccatttctaggtgcatttttctgggagataatgtatctgatgacagttgcatgtgcagataaccggcctctcatgtatccatcccgggagtgccttttctcagactgtgtgtagtgttagtgaacttgattggtgggtgtgaagtgtacagacggcgtgtgcgtggagcgggtcgtgtgcagagccccgaacgagaccctggcgtgtgcgtggagcgggtcgtgtgcagagccccgaacgagaccctggcgtgtgcgtggagcgggtcgtgtgcagagccctgaatgaggccttggtgtgtgggtgcttcagcgtgagggccacctggggaggagtgcttatctggggaggctgagctgggttggaggcttgggtgctccccctggctccgtgggtctccattgctggcttcatagctgtgttccgttttctttgttcagcagttgatctcaagtatttattccaaagcacttgaaatacatgaacctaataaatcgaacaaatacagtaaaactttagcttcttggaacatccccatatacttacaccacgtcctaaaatcctctcatgtctatgtaaaaaatcgggtagcctgggtaacgtgggatgccatctctacaaaaaatttaaaaagtagctgggtgtgatggtggcatgcttgtagtctcagctacttaggaggctgaggagggaggatcgcttgagcctgggaggtggaaggtgcagtgagccaagattgtggcactgcactccagcctgggagacagagccagaccctgtctcaaaaaaataagaaataaatgaaatcacacttgtgtgatgtcagattacccattaacccacttttgaatggagctggaaggataatccacacctacctcggatttctctgcgtggctgttttgcataggagccctgcatgggttattcttgaagtcagcactgtaggagccgtggccggctttgcattttcatcctggttcaccccagacctgctctgggcagagccaggcatcccctgggacgctctgcctttgcgtgtccacgacagtacaattccaggcactgcctggcatctgcgtctctccctcccctgaaccaggggcgcctctccctcccctgaaccaggggctcctcttcctccctgcctggcaggagctgcgtttccttgagtctcctcagactcggcagacccctgggtggtatcatgtgctattctgaaggagcttttgcttcatggcacttgaaaaaaatcctttcactggatctgagttggtgagcatgcatcttcctttcgtaggtttgttttctgaccaggccgtgggtctaacaggagccccgaacctctgggtgggctccgtgtcgcttgcgtgcctcactcatctggcaccgtgaccgcgctccggccctgagccccacttctctgaagcctcacgtgttgcccgtgtggtctgctcctcaccgtcttttctcttgtccttgcccagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgaggtaggcccattcgtcgaggtacatcggatgcgccgtgccccctgacggcgccgtgtgtcgtttcctccatgagaggtgtgcacagcagatgctcgtgaaaaggtgaaattacttggccagaggatctgtgacaaagccaccgcttggaggtcaagctccttttctgtgggtgagcaaccagagcagaagtgtgtggaggaacattctggaggtcttggccaccctgcaggcagtggattcttgggcgcaggtgatcgacaaccagagcagaagtgtgtggaggaacattccggaggtcttggtcaccctgcaggcagcagattcttgggcgcaggtgatcggcacgctgggtggcgtgggaggaagcaagtggggcacgggaatcgcctgtgcgtgctccctgcggtcgtgggtcttggcgagaggcgaattctgtctctatctcctttcaagttcctctggaatacagcaggcatgttggacatggcagtcttcagatggtgtttgtttttgttgaggagctggattttgtgtttttgtggaccagcacttgagagaatgttcagtagcaatagccttcgctggcatgcctgatgtcagctcctctgagatgtaagtgaacacttcagaacctctgggaggtagggagacactttttccctctggcttcctgatgagaaaactgaagccagcaggtttcatgggatcaccagaaccccagaagctgtgcggcctgtggcgggcggggctcctgcctcggtgtccagtgcgcgcacccagctgagccccgtagtggtgtcctgtgccagggactttcaggatctgatactttttgcttaggaaacatgcaaaacatgtgtccccagcgcaggaaacgattcaattcaattcaaccgtgtgcgctggttttgtacactgcttttggactgaaatgagttcttttgtgctgaagaaggcaggtgcttcctttcttgttgtgcatgaaggagctggaggcgggacaccgaggaaggcgactcagtgtcactgtccgtcatgggtgtgtgagcccacggctgaatcatcacaaggtttcacacccgcacttcacctgacaacttttactaggaaaatgaactagggaaactgacttcagaattatgcccaagtcttagaagctcctcctgcagctgttcaggagccgagcgtcccctgctcactacaagacgcctgaaggggtcatgggatgcagcgtctgaagcttccacctggaagtgcactgctccttttggtctgggcggggcggggcgccggtggcagatgcccctggtggcaggctcaggctactgtgctgggtcccctctgccccgcacgccccgcgagcaccagcagggcctccccggcatgtggcggggccagcgttggcctggggcccgcttggctttgatctcgtggggcttcgtcttttggacgtcctgggtgcgcctccactgtggctcctgggttccctcacgcacccgggtgtaagcgccactgcctgtgtccgacaagcagctcgttgtgaggcacacgctggtaagcagctcgttgtgaggcacacgctggtgtaggctccgaagggtctcggtgacaggcgcttttctcttgttcctgcccactgctgttccatcttaccaaatactcagtagcgtccggagagggacctcaacccggttacttccctgggtgtgcagcacgtggccagcgtctcatagtctagattcttgcatcagagcgaagcctgagaggagccgagggtcctcctcctatccagggagaccgtgtgtttcccgaggcagctgtgaacacgcacgtccctcttgtcctgctcctcttcggaggagaacagcgcggctggagggtgctggtgctggccaacgtgttatggagagtgtggcttacctgaggccagggaggtctggggtggctgagagcggctgtggcctctgtctgctgctctccccagtggccactctggcagcgctgctgggcaggggcttggctgctggtggtcttcagggagcagtgccttgcagagtggagcagagaagacggagaggtccggctttaggcccctgccgagctcctgaggccctgccgcgtgcctgtgccagcctgcagcgctgctgtctgtgtgcgggagctcttgtgtgtgatcagcctcaggaaaggctcttcctgttacttccttgtgctgctcctgcacttctaggaagttgatcctgtaactaggaagtgaaagcaaaaaaatgtatctttcttattgttgataggaatagtcacagaacgagaaaacttccttacgttgatatctcattcagtttccttagcaaccctgagaggtgggcaggggccaccgtcattctggtttcactgaggaagtcaggacagcactgaagacacctgtccagcaccttgtgctgacggcttcccagccaggcccatcacctggtggccgaaggcttctgagccaggcccatcacctggtggccgacggcttctgagccaggcccggcacctcgtggccgacggcttctgagccaggcccggcacctcgtggccgacggcttctgagccaggcccggcacctcgtggccgacggcttctgagccaggcccgtctgggcagcagctcccaggccctggcccggggctcagcgctgcctcgtggctgagaagctcctcaccacctgctgtgaggccgtggaaagaccctgaatgcagacgtgtgacggctgcagctgcatctggcccctcagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggacatgggggtgagacgaaacctccactcacctgggagggtgtctaggtgggcacggaacccagggtcgtgtatgggccatcactcatgggttctctgttttgggggaaagctgatcccactggagggtgactgtaatgagagtctccagatcaggtgccgactttggagaaatgcaggtgcaactgtccgaacaaatcaagtccccgctactggacggggctggcagctcagctggggccggagagaaaagtcacgagcaagaaagttcttacctaaggtcctggacaggcagatacataacttctgcctttggcaacgttagatgtcatcgttccagagtaaaatacctataaaaacctgccgatgcgcggggagcctggccttggtctgggtgtggagggctgggggccggccggtcggtaggtcctggtgcaggcgggccccgtgcttcatggaggttggcgccgctcggtggcctgctcgcttattcttaggcctgattcacagaggctggggccactcagtgatctgttcgcacattctcaggcatgaaccttcagggctggactcctgttcttttgtgcagtttccacaggggaccctcttgctccagggtcatctttctcactttgaagccccttgagccgcccctgcacagcctcctgttggccccgtgagggtcctgactggggctcctcttttggagcagctgccacgtgtggaccggcacgggcatggtcgtggtctgcccagctgggtgtggggttgagcccatcatgctgtggggtgctccctgggggttgtgtgtgtgtgggtcccacggtgggaggtggggttggggtgagtgtgacttctgtctggggcatgttgggtgggcgtgcaagggggtcctgggactcctgagtttctcaggcctgaaggactgtaggacgcactgtgggctgcaggcttgaagaaggatgtgagtttctggagtagcctggactgcacagccagggcctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaacagtgggtgcttgggatcagagcatcagagtggaattttcgcagggaaatggaaatgcctgatcgagctgggcggtggcagcagccgctcctcactcttcaggtgcctggctcttctgagagtcagttcgggggtttagtggctcactttttctaattggttcctagctttttgctaaagaaacttggattaactgttcttttgcctcatggtgtgaatttatactgttcctgttttataaataccagaaggagcttcgtaggtaacttttaccatgtgttgaaggtagcattggttttgaaaacctgatttcctcagtgtcgcacacgggtagcttaagaggtgggataattgttggagtagtgaatggatttccctgagaagccaagtgcaatttaggggcagtgacagtgcgaagttaaagtgggacagagtggttatgtgttatctgcaaaatccctcctaaccagtaatcacagtctaatttgcaagaaggaaaagaaagccgagccctacgctgctgctgctgccattgtgtgtccagtgatttcctcacctgaaactcttttgtaagcagctcatgttgacatcagctccgcccaggcagccacggggccctcccctgccagggggcagcctctgactttcggcctccacctcgagcaaacctgctgagcggcgcggcccagggaggatccgccgaggcctgcagatccgagatctcttcctcgggggcaggattgtcctggaaaatcaggaaatggcaggcattgctcagagctacgtcttgttctccctcaccggtgttgctcagtggcacagcttccaggggaagacaacacgtgtttttcaagaaaagttaagtggccattaccgagcagagtcctaaccctgtgaaacccggcaaatcctgcctccacgtcagctcaggtgtgactcgaaagcacttaaaaaattctcgtgttttaccactgtgttgattagtgtgagctttggttcttgggggttaggaaaattcagccataggcaggtccgatatgatttgcaactttcaaaaaacaggatggctaaataacaaattactagtctgatattttttaaatgtctgactttcaaatgacacagaattattgtttcttaaggtaaaaacagtgtatttggctttttattgctataaaatattatataaataagaaaacttgagctggggtgaggtctgcactttgctgtacctgccgaaaatgaggtgcctggagcttgggacaagtcgaggcgtgcacttccccttgactcggacaggaaagagaatccctttctgtttgacacagaccatttctctgtgttgggaaatcctggtgaagtatcacataaacttctccagcgaaagcaaacgggcgaggacacctagggcacgtttcagcgcagacaggccggcccttctcgcggcctcgcagtgtctctctccaggttcccggggatggtagatgaacgtggtgactcactcagggtgttcctgcgaagggaaactgagaggcccacgtgggacgttgggtgtcctgttggagtagtcctttaggaaggagcttttatatttatatttaactagcatcattaaacctgtttgtatttatttctcgatgagccagttttgttctgagaatgagaaaatagagccgttttaataaatgtccaaatcaggacagtgttaaatttgttgtaagtccatatatagttgattggtcgaattaacttgggagtctgtgtttagttaaaaacagcgtttctcaggcgttgctgtattttctgtgaggttcagtaaaatatacacgcaacagcaaccattttgacttctcatggcaggagccagcttcgttgaagtgggccaggctgaagtgaggccagctttgcctgctgcagccctgtggtctgtgtccaaattgctgagtactgccgggagagggagccgggagtgcctgcgtctcctgctgtcagccggtctgactgcctgagcggagctgttgaagtggactgaacaacagtaaccttagagggttagacttggtgaggatggtagatgattttaagtttcttctcttttttccattctttcttcattaatcaatgttccacactttaaatatagtaatttaaacaaataacacatttcaagaattcagtgtaacatgtgacctttcagtagtattggctggagccggcggcaataaagatagaagcctgtgttcctcttgtggcaaatgttaaaggaaaccagaaattcttgattcatatttttccctagaacacgtggctttacaggtttcaaaaaatgaaactcttgttcatatggtaaatatgacacacatttctatgcattctgaaaagatttagaataaactgccatttgttgttaaaaatagcagttatataactttttttttttcttgagacggagtcttcctctgtcgcccaggctggagtgcagtggtgcgatcttggctcactgcaatctccgcctcctgggttcaagcaattcttctgcctgcctagtagctgggattacaggtgcgcatcaccacccccgattaagttttttgtatttttagtagagacagggtttcactgtgttggccaggctgttctcgaactcctgatctcgtgatccacccaccttggcctcccaaagtgctgggattacaggcgtgagccactgcgcccggctgtagttatataacttttagttattagaagatcacattcatatgtcttgatcagtttaatgatttctaagatatcattaacaaaagccattatgatgtattgaaataggattgatcttaaaacgttcgtgctaatgtaacgtgagttccctttaattttaaaccagtatttttctcttcttatttaggctatagtttgttataaagagtatagagaggaaaatggagtgcttttctgttcatagagtttttctgaaattaaagtcaaaattttcagtttcaagtagtgaaagcagtgttaacagaaagtttcccagatactaatcctgggtcttttaagatctttagataattagttgctttccaaaatagcttttaattctgaactcattttagacttaaagaagaattgcaaaaccagtggagttcttctagaccctccacagcattctccgatgtgaacatctcacatttggaagccaggaagtgcagtgtgggataaaggccactaacaggctggtctgcccgggaccccgcatggcatctggtggtcctgtgccctcagcctcctctgctctgtgagctcctcagtctttatctttcttgatcttggggcacttaaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcccatatagtgccccacaacgggtcctgcgtggtctggaccttgatccctggtcaagatggggcctgccaggtgcctccacttgaggagactgtgttttcctctgtaactagcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctcgttcctctcccagctttatttcatcattcgctcctgccagtgtggactcatgggtgctcatcctgtttgggggttatcatctaacactattgttactagttttgtttgagttataatctaacactaactattgttattaatgttgctcaaattgctccagctttggccacttcaggttggcttctgtgtcctttcagcaagatcctgttcttttttttttttttttttttcttttttcctgagccttttttctttccttctggcaccacaagatgcacctggcttatctttttgcccctgccccagccctagcatccaccacttcccaggagtctcacatcctctcggtggagaacagtatttggaatccaggacgccgggcttggcctcagctgcctctaggtcccctccctctgtagctgagtgtgtgcccctcttcacagtccatgtttgcacagacaccagctctagcccagcttcctcctggcctcccttcgtgtgccgcttctgggcctactgtgtagcacgctctgctgccgtgcgtctgccgtcatgcatctgacgtgattttggagctgccagcccacacctgtgtgagcaacagactcaccactcagggtgggacgctctgtgcatcctcctcaccctgggcatagcgttgccaggccatcgctcgggtgagcccttctggtgctgctggtctgggatgcagacaagtctgccggttccctctgtgctggtccgggatgcagacacgtctgccgcttccctctgtgctgggctccccaggtctgtgattgttgcttcttcaatctgcatgtggttgtgttctacaactcaagcaccaaacaggacagtccgtctcccccaaaaactccccagtctgctccccaaccctgggccaacattggtctgattttggtcctgatagtttaccatttctggagtgtcttataaacggaaataatcagtaggcttttcattctggcttcgttgacttggcacagtgcccttaagactcatcccagtgatctttcctttttttttttggagtggtgtattgttggacggacctggcggtcacaggcctacctgtctccttgggtgtctccagtcctttctggaggctcaggggggctcaagggaagactctgcttccctgcttgagttgcccgcattcctttgctcatgggctcttcatctaccttcacagccagccacgtccacgtctcgcttcatccttcacgtaccctatgcctgtggtcctttcttctgcctcctgtgtctgtccttccttcttccttcctgtatgtatttatctccttacctgtctacttatcagtctgtctagatggggtctcgctgtgttgcccagactgtactcaaattcctgggctcaagggatcctcctgcctctgcctcccacagacagatggagcacaggtgtagccagggccgctggtgtgtaccactgtgttcggcacccgctgggctgcaggagtaatccagggccctctccccatcttagggtcaactgattgccaaccttaattcccctttgtcaggtaaaggaacatgtttgaagtgggacacccttatctttgggagtgggtattattctgctgaagacaagggtggggacagatatgctgtgaccagggtagttgggcttatgactttgttgttgtttacgtggaggaactgaaagacctgggtgtgctgctggatgccccaaggatctggcaggaggaggcatccaggccctcagggcaggtagcgggtgggcctccgtggtgttgggaggtgctgggcccggaggtatcagcaggaactgcagggtccctaccgcaggctccccacacagtgacacctgtctgtccgtccgtctgtccacaggagcaggaggggctgggcggggaggacgcagggtctgtcggagcatagcagtggcccgtacgtgagggactttgttgttgccgtctccccagggtgcagagcgtggtggtttgtggccatccttgcagtgtgagtgagcaagtggccgaggggtagactttggatggctccaggcggaactcggggaaggaggccgtgtactcccatagctctgggctctgtttgtggctgtggccacacagggcagggcctcagggcagggaggccagtgcttttgggaagggcctcccccagccctcagaagcctcccaccctattccccttgggctccatccttctgttttttttctggctctggttcctggcgtctgtttgcaaggctggctggacactgcaaccacctgggcttgctgctgtggcctggacgctggggtctctctcggcccggtggtgagctgagaagcggccctgtggtagaagagggcctttccacgctgagaccacagattgtccctgcaataagcaaacatttctctaaaatgtgagataaacgctttatccactggtgatccgtggttgttagtaattaaaccaagtaaacggtagctcattcggtcaggccgcttgccgccgatgaggggtgcagagcttctgcagcatcctggggaggtcccggaacgtgggtctgggctgtgctgatgctggagcagccagcggggagagctgccaggccactcctgacagccccgcacccgctctggatggaagcttctcgctcccagccgatacgggcctgctgcctgctgctggggctggaggggcccctctgcttgagccttggggtaccccgtgcctacgtgccctcctggctttgcccatggttggtggccgtgttttgggctgcgttgatgtcgttgtggagcccgctctgggcctcggcacgtctgagcttgattggggtggaaaatgcacctggtggtttgtattatgttgtttctgttttatttaatttcatttgccattcttatttcaaaagatgcttcctatgtttatgctatattgttagtttaacttcctaccctttccatctatgaatttctgtttttattgtggttctcagtgaccacactctaggggtcctttctctctctctctgtctctcccccctctcccctcctcccttcctccctccctccctcctaggcagagcctgtgagacttgcaggcatttccccagaacccaggccctcttggccatctggctgctgccccacccaacctttggcctctcctggggctcctggatggttgggcgtcccaaatccccatcagcagagcacttggtcacaaggcccgagtcacatgccccagcttctccgaggaagtgcagagtccagccgcagggaggactttctcaaccggccctggggccagctgtcctgctcctccttgtttgctgtgggctcacctctgtgggctgctcactcagacccactcgcacccatgggaccttcccacctgtttctcctgcctccttcagtctgtgcccagcaccccgctgtcaagcccattcccccccagcccctgacgttggacatgctggaggagactgtggccctgtggcgtgttctgggccatctccagggcctggagcgggcacctgtgcccagcactggaggctgggggacaagtgctctctctgataaatgcccccgagtttcagttctgtggctgtagtttgtaggtctcctagctcagcatccccgagcccatgccctggggactcatggggccgaggagagaggagcgcagagaacatgaggatacgtgagccccttgcctgagaggtgtgctgtgaacctggagagcaaggccagtgggtctggggtgacagacagtgcgagatgcaggaaaacaggctcgagatgctgtgaatctggagaacaagtgggcctgggtctggggcaacagacagcgtgagacacaggagaacaggcgggatgctgtgaaaccggagagcaaggccagtgggtctgggtctgggtctggggcgacagacagtgcgagacacaggagaacagacgggatgtcatgtgcattgtggctggcagggccggcgcctcacacacacgccccggaagtcaggatgtggtgctgacggtgtccgcgctgccaggctggagcgggtgacggtgcctgcgctgccaggctggagcgggtgacggtgcccgccctaccgggctggagcggagcttgctctctctgcagtgggacctgctcacttttccttagctggatgtatctttcacatttagcttaacagcagagctggtgagaggacgcacacctggcgtcaccattgtcccccgtgcatgtccccggcgtccttcatgttgacgcgggccccgccccacggctcaggtctgtcaacttccctggaacaaggcagagcacttggcccctggaagacctggaaaccaggaacctcggaggcgctggcggccttggaggccgcttatctccgcgtgtctgaaattctgttttccaccttttccctttaggctggtaggaggcgcaatctctcaagccttccttagaaaggatgattgtcctccaccctgccccaaaccccctgtgttctgtgcaacgcctgatgagagcgttctgggttattcacagtaactgagctgggtgatctcacaagaggacataatgaagcccaaggagcctggtgggggccgggagaggccttgctctgagtgtggctcgcatgggggcagcgccttggcgtctgtgtgtggtgcggtggttttcctgccactctgtggaaggggcctctgccagacgccttgtcttcagggcctcaggtccctctgggcacggtgggtgttcatgtgtttctgcagggttaggctctgtgcatggcgtggtctgcaggacctggacagcccctgccccggggcatttgtgtcggccaccttggtttgcccccctgtccaaacgctgccagttctcgtcctccagggcactccgtttctgtcttttcattcactggacctccccacctcctgcgccgccccaccacagcaggccaggtgcgttctgcccccaggccctgtcctcgtggctctttgatcctgtgccctcggtgtgcaccgtctcgtggctctcgttagaaccagggtcggccacccccagctcccacatggcgtctggtgtcttgggggtcacatgtgtctgtctgcagtccctgggtgcctcaagctgtgtgttgcctgtggggcatgtctgaacctcaagtgggcctgagtcgtgagagaaaggctttctcatcgatactgtgtggtctgtactgttttgcagaatttctttttaattaatcctttctctttttcacagtgcactggtgattgctgcggtgtttgaccgagacataaactgcagaagagcagcctctgtaagttttctcattttgatatttcctttcctgaaggtggggggtgggcctggtctccctgatgctcctctgtgcactgctgcctggccagctcacccatccacagcaggagccgcgagggagctgctgagagtgccagctgcgggcaggccactggttcttactgtctctgggcgtcttcagcgtgtgaagggcggtcagggttaagcatccccagagctgcagccatcactgctgggggttgatgggtgatggaggcgagtgggaggtgcccgatgacaggtcttggtgcaggcagctgcacgctgaagacgcagaagagagtgggttctgcgagggtggccagaatgtggcggcgggacgggtcactcaccgggtggctttgagcctcgggaggggctgttgcgagcagtggtcagctctgcttcacccgccacactcgcctgggccttgctggatgtgggagctgcctgcaggaccgggtgcgtcttgaacacagatggctggtttcctctagagagagccctgtgacgtttggggtgaattctgggtgtgaggagctgtagcaactgctgctgcgctgagcagactacttcatttggctcagagctgggctggagtgaggcctgtgtctcttgggaccacagagagcggacagttgagacggtggaccagtctcaagataagagtctttatttcagatacagataagacgctgaacacgttttaagagggtaagaacagagaggcagccctttgagaaagatggaggggtgaggttggcttttggtgatggggtgggccccacagttcctcatgggctcgagctgctggaactctgtgtgcaggctcagcatagctggcttagtgggaacctgttgagggagccgttcacactccctgatactgtcagacttgggggccagtggaccaggtggaaggggtgctgggactggtgagggtttcctgtcagccctgcagtgtgtggcccctggtgagtgggaccaggcggaaggggtgctgggaccggtgatggtttcctgtcagccctgcagtgtgtggcccctggtgagtggggccgtgcaggtgcagtgttggttctctctctctctcaaatgcaggagctcagatgataccctgaagtctttctagctcaaaatgtctgtcatcttctatagcttctggtggtctgcctgctctctgtatcctgaagtagttagaagtctttctctgcctcaggtcctttaaaactagagagaattcaccaggagagctcagaagctcttctctgtccctgaagctgctcttattttgtcttcagcatcagtaaaaacctcataattttttggggaaatcatcacatttttgccctgctatttacccaaaggcagtaaatgtaagactttgaaatataatacaattttatgttaaatctgtacttaaattaagcttttagattttctttactgcaacctaagacatttcatgggaagcagtaataaaattaaagtacttaggcttctatgaaccctgaatatgaagtgaaataatataaatcatttttcacattaaaatccctttaaattggcaataaatcttttctgataaataccaccgagtgcacctagcttaccctgtagcttgcaaaattaaaacagccaaaggtaaaagacacctttttgaagcttagttggaaatgtgaggattgagggcctcataattgggaatcattttttggagctgctgctttcagataacaatgtctcggtctttctggctcagcttggcttcctgtttgacgctgtgtcactgggtgaggtcacccctgtgaggccctgaggcctcttcagcaccggccaggaggcagcagcaaaaggcgttgaagtcctgtccctccttggggctggacacggtcccttgcccctgaactctagacgccctgcattgccctggtgctcccatgtcaagactggccgcggtcgtccatcccatggtttgtgaccctcccagcaacgctgtgaggaaggtgctgcagctggttctcagcattggcaggagcatggcgactcaggcagtcagtgtgtgagtgagtttgtgaaaacagttccagctgtgttcgttgctgaatgctggtttttctgcatattggaaggaatctagcagacccccaaacgtgctgacattgcaagaagacatgtctcccggcggggaaggaatgggcagtagagatggggtgtggtcgtggcttcttgttcatcatgaggaagggagatggggccccgttcactcacagttaaagtaaaggcacttaaagcctacatttaactgagaagattttaaatctttttcttccagcatttcgtttgatacatagtgtctgacctctatttgtgactttttattttgggataattgagatttatatgcagttttctcccctcccctcccctcccctcccctcccctcccctcccctcccctcccctcccctcccctcccactctgtcacccaggctggagtgcagtggtgcgatcttggcttattgcaacctcggcctcccgggttcaagcagttctcctgcctcagcctcccgagtagctgggattacaggcgtgcaccaccatgcccggctactttttgtatttttagtagagacggggtttcaccatgttggccaggatggtctcgaactcctgacctgaagtgatctgcctgcctcggctcccaaagtgctgggattacagacgtgagccactgtgcctggcggagatttacatggagttttaaagactaatgcagggagagcccatgcgtgtttcaccattgcctccatgatgaaatctggcaaaaccgcaatggaacatcacagcctagaacattgagccaacccaccagtcttattccttcttccttggttttacctgtactctgtgtgtgtgtgtgtgtgtgtgtgtgtgtgtgtgtgtgcgcgcgcgcgcacgtgcgctcacgcgtttacttctgtgtgattgtatcacatacaaattcacgtatccaccaccacaatcaggatacacagcagccctgtcttcccgagaggcctgtgctactgctttgcccacagtccctgctgtttccctctcctgacccttggcagccaccggtcggctctccgttgcctattctattctgtcatctcgagaatgctgtgtaaatggactctgtggcctctaatgctgtagctttcttctctcggcacagctctctggagacccaccccgagcgtggtgggtggtgctggtttgctgcttctgttgctgagtggtgccgtggtttgtgtgaccattcatgtattacgacatcaggatggtttctagtctttaagctgctgtaaacattcgtgctcaggttttcgtgtgagtgtaacttccatttctctgggttaaatgccaggagtagtttctgggtcgtggtagttggacatttaaactgctttctagagcagctgcaccattcacgttcgcaccaccacctgcccgcagccctgcctttctctgtcctcgcttgtgtctgacatggccactgttttctgtgtcggcctttttgacaggcatgtggtgatacgtcgttgtggtctttacctgcgtttctgtcatgcctgatggtgtggagcatctttcacgggcttacttgccgtctgtacctcctctttggtgaaatgtctgctcaggtcttttactcatttctaagtggattgttttttgtagttcttgagtttagggcactctttacatatgtaggattctggtcctctgttggatttgcgtttggctttctcccagtctgtagctcatctttccgtcctcttcatagggcaagagtttttaattttttaattttgctggggtctcgatcagttttttgtttttgtggctcatgtttttagtgctttttaagacgtgaagactttcttaaggtctgggaactccacctcgcccggtcccggggatgctgtcccgtgttttctgttctgctggttggtctgcgtgtctgttctgccagcgcacactgtgtgacgggctgtgctgcgatgctgctgtgcatagtcagccttcgcactgggcagggagatgcctcccagcgtcttctttctcaggactgttttccctgttttagggcttgtgcttttccacataaatcttgaatttttaaaacatcttttagataccactggaatggtacatgtcttcctaatagtgtatgttaaattgatgttacagtatatctttgttgcattgccttttggcgggttttgtttcttactttcctaatgaatttatcacaaaagttacaaatttgcaaagcagcagtcaggcctcctcccagcctgctgtgaagcgcctgtttcctccaatctccagcccagcccaggggtctgccttggagccacccgcacgtctggtttctgtgtgattggccagaggtggtgggcgcgtctgctccttttccctggggggtgggggcacagaccctgggtggctgtgttcggctccttacttggtgcccgtctgtgtgtgctcctcccagcagccatcgctcaaccttgctctcaggaagcccccaggcgagtgttggcaggaatcctgccaggcgggaggtcgctcctccagagcgtggtccctgaagccgccagcctccctggcctcgccccttgctggtggtgtgtgtggtgtggccgtgggtgcactttgctgggtcttcctgggacactgaagtctcctgtgtctccagccctgagaactcggagcccgggtgcttttgggaaggacggggcaccagctggtgacacatgggaagggaggtgtggttgtcaccttgcccaggtaacctgctctgcctggtcggtgcgcctaaggggggcagggtgtttggggaggacatgagaggcctcctggaagcacttcatcctgttgaagttcacattttgaccttttcagcagcccttgctctgggcctgtgcccggccctgggactcggcctggagagcctattgacaccgtgccatgggtgcgggcagggcgccctccctggagggcggcacgtggtgccagttggtgaccatgagctgcctcactcctgaggaagagtgttcgggctctgggctttgatttaacctgcctgtctgtctctctgagttgacagccggggcctccgcgtgggtgctgctgggaggctcagtggtaaaggccacttttcaggatgtgtctgattttataaacttgaattcttaaattgtggttttaaagagcaccaggacgtaaaaacagagtgacgcaccttgaggctctgttcagccaacaatgagggcttttatttaaaaaataaagccgtgggtcattcacgttgtgctgtttgttctgaacttgcctctggtgttggcggaagctgacctcgctcacctgctgtgtttgttctttgctccgcaggccgccttccaggagaatgtggggagacaggtatggctgctttcaaacacctttattccaaaaacttcctgcgggtttataggtaggaatcttgagagctataaccctggtgtcttctcgcactgtgagatgtggtgtggctacatcaatgccagggtcatgagttcactataggacgcacatgttaaacagcgagtcctgtttcacagggaacctgcatgtacagtaatttacacacacaggccggaaagctgtgctttacacgttgccaagagccacataatgtggctctgcagggtggggcgggtccctgggaccagcctggccttgcggggacgcagacctgaccccgcctcatcccacacagagcaggagctggctctgttgacgtcagcttgtgcctcatccagaccatagacgggcccagaagtcagctcccagaagctacggaccccatgaccccacgaccccacatcatgctggggctgcttttgctgtgccctctgaccctgacatctggtcactggtcagcttcgcctgtgaatggggggccccaggttactcatgttgtgtgtgatgacgtcacatcttgggcgtgtggttgggtcttgcaggagagtgggacagaggccggagaggggaccggggtctgggctggacctgggcggggagcaaagttcccacgagaagtcagccgagaaggctctggagttcccggacagcaaagcaaatgcagccggggtctgggctgtggccaggtggtgtggggcggcatggggtggacgtgggcctgcggacccttctgacctgtggggagccctccaggcaaggtgtctgacctggagtggaagcattgaggccaaatgagtccacaggaaaagccggatgccagagtcagctggagaggcgggcggacgaggacttgcgcctgttattgaaatggttctggaggagcctggcgtgagtggtgtgggcggctttctgtagacggagcccaggaaggggcgtgactacttcttgctggcccgaggcagccgaggcccacccagcatccttggggtgccgtggggcctgcatgtgttcagagccctgagccctggtcggagccagttcactaggaagagacaccagccttgcaaggggagcctgggtgtgcagacagcaagagccgcccaggccaaggagaatgtgaacgaggtttggtcttttgagtggagagtgtggctgctgtgaggaagaaggagcttgttggaaaccacttagctgagcctagggacttgccagcttcctggaaagtgagagcccaggagaagaagtctccctgtccctgggcttccagcccctccagagcccccactggagaggggcgtgctgaggccagagcccggggtgacgaccgtgctgggtgggccctggggcgcactccgccatcactctgtgttccgggttcccagatgctgcttcctgggaggagcagcccagtcgcatagggagccacggggccctgcagctgagctgaccagcctccctgtgtgtgtggctggatttgagccacgttacctttatcggggcagctcaggttggggattgattgacagggaaaggaaaggcctttacacttggtctaaatttaggcaagcagccagaaaatgggatattcccgtgggtgcgggagtcttgcacctcagtcctgagcctgagcagtgtgagtctcagagcatcctgcacagtgaccagcatgcggacggcagcgggagcctcgtggaagaagcggcacagattttgaagagacacagactttgaaagaaatgcaagacgcgcaggtgcggagcgtctcccagccccgcacggccatgtcctgctgaggttggatagaaacatttgagaagaaggtcgagaacttggcaaggcaaagcaaacgggagtggacgtgtcgcatagcacacagggaagcagcctaaaaaccctcggatttggaggaggctgtttctaatacacagatttggaatgaagttgtaagaaatgcgttacagtggaggccgctgggtaacagcagcagggatggggggtggttggggagcggcctgggggacacagagggggctgggggcagagacgagggaccagcttctctgtccaggttcgtcttggctggagttggagactctggtcctgagtggtctctgccttctccctactgagcccaggggctcttgagcaggttgtgactaacccatgggcagcttccacgttcagggcctgtccgacattccagccctatgaccctgctcctaggcgagtgctgtccaggcccccgacaccatcaggcccttgtggtggcctgtccacacccaggccccccacttcccccctgcacaggtgaggaagttgaggctcagggcagctgagcccgcttttgtctgctcggagcctgttgttccagccctagcctggccagacagagccttggcccctgtgttggtcttgctttgttctcaccgtggggggatgctggacacagagtccccttgttcttgttctcggtgagacctggtcctgggccaccccggatgtttccctgggctcctgcctgctgtgatgtggggcatggagttgtaccccagtgggcgacatcccaggttgtggcacctgctgtctttctgcagagtgagccgcaacagctccacctgggtgcaggtttctcccctgttcacggttcagtgaaggatgctcatgctgtcactgattgcagcagcctcaggcagaagtttatggtatctccatcagcccaagctcccagtgtaacccttgggagagatttgctggaagaaagccgcatggtacctgctcattccggcctctcctggtgggaaggagggatgtggccccgggtgttctcaggagtgctggctgttcagttacgttgacttgcgaagctattacatgaaggtgtgaggttttaatggtcaagtgcagggtggtgatgaatgggttaaagacgtcaaggaaggatctgaatcccggcctcggaggtgggcaggcttgggagacctttgaaaaaccctgctgtggtttatagctgtaaggctttctatgtggggtttaaagtttgtcatttgtattttcttaggaaattatttatgttgtttccagaatttcacatcctggaacctgagagtggtatcagtaacaccatgtaggctgcggggctggagctggggctccactgggaggctgtcgtggcggggtgggaggaggtgccgcctctcccatgtcagagcctcggcggctgctggtcctcgatgcttctggggtcagctgtcaccacccccaagaaccggctgggccagctgcccccagtcaacgtcttgcctgcccgggactgctgagtgaggcctgggctctggtccaggctttgtagaccgtgcaggcggctgcatccccgacctgacccaggcctgctcgctctggtgtgcaccgacctgccagctttgtggcactttgtggcatggggctcaggccgatggaggtcagtggctgtaacactgttgagacctgaagaccgtttacggtgtatgttttcgggaaaggtctcttaccacgtaccgaagtggaaatgtttgagttgtttgaaaaagatgaaatacttgtgagtggtttcaatgatttagcgtggtgttgcctgggtagaccgtcaggaagtcagtgtgacgtggaagtcctcggcgagccatgtctgtggtgtgtggcttgctcaccacctgcctcagggctcggggttcatgagtgtaaatgtctgtggatgtgattattgaacttggtgaaatgcctttgttcattcaaattcttctttttcccccatttccactttcttattagggcactttccctcatggtattgatattttgaccacagctgactattttgccgtcggtaacagatccaactgtttcctggttataaggtaagtctttaatgtatatcacaaaaatagaatactctaaaatcagattggatgtcagaaatcagctaccaccattttcttttttcatcctgtaatgtccactcaatggaatgtagtttttgtgtgaaaaattaaaaatggaattgggaacagtgactgaaacttgtgtttcatgttgattggacacacctcatgctttactacgctagataggggacatttactcacgtgttaaagaggggctcagcttcaggagtgcggccttgccgtgagtgctgtctctgcttatgatttttctcctggtcgccccgttttacccgtgctggttctgtgtggggcttggagtttgagaggaagcagctgcaagcacggccacacctcctcctgatgcttccctactggatgtcctaaatgctttcccaccgtgaaatcttggattagaagggactgtttctttctgtttcggtaataggaagtgttttgaagttgaagttatctgtagattgtctatgaaatgagtaagaggtattttagaaatcaggttagaaacaaatgtttagcacctctaattgcagtttacagaattatatcaaactgttttagttgtgtaattaggtactggggaggttacttcagttatcttagttgatccattgcagcagaaatgtgaaaaagggtgtgactttatttatttatttttggagacagaatctagctctgttgcccaggctggagtgcagtggggtgtgactttatgaagtgatttatttgccttaaattaggaccagaagcatgcccgatgcatttttaacattaaccattaaataccctaaagatcgattccccaacagccctgctgtgtagaccgtgcagaaaggacgtttctccgtcaccagcctgggcagaattttgaaaatgtagcatttggcctctttcccaggaaggatctttgaacacacttatctgtatttttataccctttcaggtttcctcaacatttaatgtccttttttgccttatcagttctttcctattaatacttggccatatattttatgtggaaaatctactggcccgatgcagtggctcatgcctgtaatcccagcactctgggaggccaagacgggcagatcacctgaggtcaggagttggagaccagcctggtgaaaccccgtgaatactaaaaatacaaaaattagccaggcgtggtggcgggtgcctgtaatcccagctactcaggaggctgaggcaggagaatcacttgagcccgggaagcggaggctgcagtgagccgagatcgtgccactgcactccagcctgggtgacagagtgagactccatctaaagaaaaagacaatctaccaccttttcccgagtttcctgagtaacacacctgacagctatgggaagcttcagcatatttcccttgttgctgaggtttctaagccagcctaaaactcgcatgtaattagctgtgtgcgttttataaaaacatttgccaacccaagacctgggtccaggcatgtcttcccccagtgtgtttggcttcctcacgatgccaggccctgcgtgcagaccagatgccacttgtgaggacgcaccggcaggcaggcccctccaatcctgagggcggcatcacggggacctgcagtcatggctgcaccctagtaccgcggggcccccctgcacccgaggcagggtcctgctgtcagcctggaccttggggtgagggaggcagtggtcctgttcagcagagggcatgggactgagcacagcccatcagggaggagagttagcagggccctgggccctggcggggagctgctgggggcctttgagccatagtgaagagtgtggattgtcctgaggtcatggcactttgatggtcaggtctttgttttgaacatatccctgtggctgtatttggtgactggaaataaggagagggcttgagggctcttgggagacgggagagggctgggggcctggaggtgtgcccgctggaggaaggtgggagttgccagggcattacagagggtctcagagctgtgttggcatcactccgcaggtggagggcacagctgagggcgacagtgtcgttgagtgcgaggaggttggggcctcagcttgcacgtgctggcctgcgaggaagcatcagccgtgctgacatggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtgcatgttcaataggtacatttttgtaaatgttaacatctgtaaattcgtacctatcaccacaatcaagacgagaaaaggcccaggtttcccctttcccattcggggtccctcccctcccacacccccttcttcaggcacccctggtctgttgctctcactgcagctgtgtctgcatttcccaaagctctgtgtgaatgggttcaggcagtgggcactctcctcactcacactggcttcctctgctccatgcttcctgcagactgtccgcctgtggggaccgtcccccgagcctccagggccaggggtgtggtacgtggcgtctgtctccactcacctggtgaggggcttctgggcagtgtcttgtctgggttgtcacaggtgcagctgcggtgaacatgtgtgtacacatctgtctttgggcctgcactcttgttctctggcatagatgcccagagctgggtggctgtgctgtcagttttttttttttttttttttttttccttttgagacagagccttgctctgtcacccaggctggagtgtggtggcgcaatcgcggctccctgcagcctcgacctcttgagttcaagcgatcctcccacctcagcctcccgagtagctgggactacaggcacacgccaccacgcccggctaatttttgtatttttctgtggagatgacaaatcatgttgcccagggtggtcttgaacccctggtctcaagtgatccacctgccttggcctcccaaaatgctggccttgcaggtgtgagccaccacaccctgcctgtagctttttctgaaatggccacatggctttcggcgtgatggtgccacgcgcccccggtgctggatgagctcggggtccgggatctggggtccttgccggcgctgggggtgttggtctttcaagctcggggtccgggatctggggtccgtgctggtgctggggtgttggtctttcaagcttggccattgtcatgggggtgtgggagcagctgactaactcgtgttctagtgactgatgatgcagtttcagtcatcatccatttcaggggcgtgtttaacacatctttcgcccatttacttattaggttagtcgttttcttcctgttgagaatttgagaattcttcatgaattctgcatacaattcctttttcagatgcttccttgctacatatttcctcctgctccgtggctttccctttcagtatcctgtatattcctaagtcaaagcctttttaaaaaaaaatcagctttgggccgggtgcggtggctcacacctgtaatgccagcactttgggagacccaggcaggcagatcacgaggtcaagagatcgagaccatcctggccaacatggtgaaaccccgtctctaccaaaaatgcaaaaattagtcgggcatggtggcgcacccctgtaatcccagctactcgggaggctgaggcaggagaatcacttgatcccgggaggcggaggttacagtgagccgaaatcgcgccactgcactccagcctgggcagcagaatgagactccgtctcaaaaaaaaaaaaaaaaatcagctttatctttgtacatctactttattacatatagtttacatatagtaaaattgccagttttcaatatgggtttaagtgtggcagcgggtttggcagatgtgagctgttgaatgaccaccactgtggtcagtgtggtgcacatgaccctccctccaggaggcgccatcctgactgacctcctgtcgctggggctcccccgttttagaatccgtgcaggtagcttccttcatctgctgcctgcctcatcagctgcctgtgtttcagggttcctcagtggttctcactgtgtggacgccccacatttgaggggctttgagcccccgtgggttttgatgtgagcacacggcacagctctgttctccccggctggttttctgttggagtgagcattgagcccccgtgggttttggtgtgagcacacgtcacggctctgttctccccgatggttttctgtttttcatgagcattgagcccctgtgggttttggtgtgagcacacggcatggctctgggttttggtgtgagcacatggcatggctctgggttttggtgtgagcacacggcatggctctgttctccccggctggttttctggttttcgtgagcattgagcccccgtgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggctgcttcccacagctctgctgcagaccctggggcttgggccgttggacagctgagcagaggcttcgttttcttttcctatgtgcaggaggctgaacaccgcttcaagtggttgaagtgtgtgtgtattttctgtaaactttttgatgatatttctgctacactattttttttttattgattcagaagaactggtttattttagggaagcctcctgttggtaagatcagttgcggttgttttttcagatttgttgtttgacttttgactttgtttttggtgttttcctggtagactttgttcggcatatgtgttggtagggatcgatttcttctgtggctctgggtttcgagtcataattagaaaggcatatcctacttagagattattgtttaaaagtcttccgtgttgttttcacaagatgtaacttttatttttgagacataatttacacgctttcagctgcccctgtatggagtggacggttgtggaggggctgacagtgtgtccacctgcgtcacctgcatcttccttgggagtggagctcccaccacttccacggccaacactccttccccccagcctgtgtgctgctgccctgccctcgacgcggagcagggctgcccctcggggaaggtcgtatccatggaaccagagggaacacactcctgtgtgtcaggttctttgctcagcgtagtgcgcctggggaccgtccgcagcgcgtgtgtcctcagtgcatgtgtcctccgctagtgtcctcagcgtgtccgcagtgcgcgcgtcctcggctcgtgtcctcagcgcgtgtccgcagtgcgtcctcagcatgtgtcctcagcgcatgtcctcagcgcacgtgtcctcagcgtgcgtgtcctcagcgcgtgtgtcctcagtgcgtgtgtcctccgctcacgtgtcctcagcgcgcgcgtcctcagctcgtgtcctcagtgcgtgtccgcagtgcgtcctcagcgcacgtgtcctcagcacgcgtgtcctcagctgcttttcgttggtgagtctttgctcagcatcgtgcgcctggggcccgtcctcagcgtgtgtgtccgcagcgcgtgtgtctgcacctccttttggttggtgagttgtgtgcactgttctgtggctatacaatttttctgtgagtttgcctgacatttaggttattttgaatttttggctctgatgaataaagcagttgtatatatttatttagaaatcatcttcatgtggatgtgtattttcatttctttcagataaagagttagaatttttatatatttaactttatgagaaactgccaaactgttttgcaaagtggctgtataatcttgtactttcaccagaacgtatgcagcctctggttttcccacatctgtgccaacgcttggtatttaccagtcttttaaaatttacccattcgagtgggggtaacgatttaacaattagcattcctggctgaatactgatgttggacatcttttcatgtgtttattggccttttatttattttcttttgtgatgtttatgtacaaattttgtatcaattttttgtttggggtttatctttatatattctgttacaagtcggtttgccttttgattttcttaaaagtttttaacagctttgccgaggtataatgggcatatgttagctgtatatggagtgcagggctttactgaagtgcagctggcacacactaaccagagcgcacagcttcctgtgtgtgacggaggcctgagcacagccatcaccctggagcccccccatgtctgctccttgtaattcccgcctcggtcctcccccaccctgaggcccctgatctgcctctgtgggtgtagatgagttttttgcacgtccttgaattttgtgtgaatgaaacaaagctgtgtgcactcattttgtcagtcttctttggcttagggtagttgagattcagattgtgtgtgttgttgctgagtattcgattgtgtggatcaaccacggtttgttttccccgtggatgatgtcagggtggtttccagatttcgccgttacacatgaagctgtgtgcacgtttgtgtaaagcccgtgtgtgcacagatgctcttttcttttgggtaactgctcaggagggaatggctggatcacgtggtagatttgaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatgggtaggttttctgtttttgtttttctaagagctttttttccccccaaaggagagattcagttgagcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcggtgtacccgtgcaaatgtccacgctggcgtgttgtggagtgccgctgccgtccgagggggcgcgggcgtagcttggaggcggactctgcgttgtctccctcagcagtgcttcccgctgactctgctccatgtggctccacaggtggtttctgcgctgtctcctgggagcccagcagttcttagtggccgttttcatcattacagtagcagcttcagggtttccttgcatttcataggcagttaaatgtgtctcagaaaggaaaagtgaagtgcggtctggagcataaacagcgcgttagtgctgtgaccgccgccctgaggaggtcagagggtcccctcctaggacagtgccgtgctgtggcactcctcacggagcctcgaggagcggtaggtgcctgtgggtggaggtggctttgtgagggtgcgagtccagaatctcagtttcagagttggtgtgatgtggagggggtcctttctgatccatgggggatgcgtttgctgctgcctggggagcggcccggctgcctgccgtggtcctgctgcctggggagcggcccggctgcctactgtggtcctgctgcctactattggtcctgcttcctggggagcggcccggctacctgcggtggtcctgctgcctggggagcggcccagctgcctactgtggtcctgcttcctggggagcggcccggctacctgccgtggtcctgctgcctggggagcggcccggctgcctactgtggtccaggcagggccctcaggactgggagcctctgggaaaggaactcctgggtagcactcgggctgccgggggaagaccctcccttcattcgcttacagagaggggtgtgaattcctgagactcggggtgtccctgcaaatgttacaccaaaactctctccattaggtacaaggtcccctaaaccgaacctagggaaaattaattaatttgtcagttgtatcagccgattagtcaataacgtctttaaaaccaaagttacagatatatgcccgtagcgtcggagctgtgggactctccagctggtacatatgcccgtggcgtcggagctgtgggactctccagctgttgctgtctgtctctgcctcagttctgtcggcctttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgctttgctttagtttattttatttagtttatgtaacccttgaaaaatgtgaaaaccattcttagctgagggccgtccttacgcgaagaggcctcgggctgggcttgcggctgcagactgcattgcctccgcttctcaggtgctttgtcttttctgttccctcagagttgcaggcgatggtcttctagacagcatgcagttgggtgtcgctcagggtgtggagtcctggcacatgagacgccacctgcctcgaagagctctttgtttaccgttagaagtggaccctgagcagggccctcggccgacaccagaggggctgtggcaggtggtcctgccagcgcgggcgtctgccattgtgcctggtttcactgtggtgctgtgggtttggtgtttttaaataattagaggacagacacccgccttctgcatgttttcaccttcacattttgcttctttgttgttacatggtcgccctcatgatgattttaagtcaggaccacttgctgctccagctgggtctggaggggctggggcatgagctctgcgggtcgctcccagcttgaccatctgcctctgcatggagctctggaaggaggggtgggctcaggaggggctccagcctcttgagccggtcctgggtcagcctttcgcggtccgcatgttcaaccatgggtgctttcagtgtgtgtctgatgaggcagttattggatatgtgccccagatttggtgggtgagcctcaggaaattccttctgttcaccccttgtaatcgtggaggggtggtttcacgtggctctatctcacactcacaacctcagagtagcgtgggggtggggaggccggacacccaattgccacctggccctgagaaggaaaggcagctgtgtcccaagaagaaccgtggttagccgtgtgacctcgctgttgtagactgtccttgtcgtctgttggagtcggaggttcttgtactggttcgtgtgagtgagtgagtgagcctctgctaagtggccggttgaggactcgtgtgttgtctccctcactttctttttatgaattgaataaagctagaatcataaaatgaaggcacttacgacattctctcctcactctcagggtcatccgagagttggctgcgagggcgctgcacaacctggcccagcaggcacccgagttcagcgccacgcaaggtgggtgtgtgtcccggccggcctgcgggcaccatgcatgcactgcagaaaggcctgggttgctggtttcaaaggctgggggctgaaaataaggttgtgcttctgtcttggtgagaagcatctgaggaaagagctgtggacttgatcagtggataggctgtgaggacggatgcggtgagtgtgtccgcctgcagggcagggagccgctgaactgtgttacgtacaccggagcccgtgatggtcccgccggatgcctgacatgcagtgctgcttccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctggttggcatgcacctgccacacgacactccttggtctctaggtggcttccatctgccacacgacactccctggtctctggttggcatgcacctgccacacgacactccttggtctctaggtggcttgcacctgccacatgacactccttggtctctaggtggcttccatctgccacacgacactccctggtctctaggtggcttgcacctgccacacgacactccttggtctctaggtggcttccatctgccacacgacgctccctggtctctaggtggcttgcacctgccacacgtgaatgcactttggaattgggcagcgtgtatagaaagaaaaggcctgaatgggagactcaaagtctgcccaggactaacatcaccttggaatggctcagctaagtctgcacttcttacacttcatcagtgaagagagaaatcctgtttgttctgtcttgtttttttctacttggaataaataatcatctgacttaaatgtggggaagaatacacacatttctcaatgtgtgtaccgtcactcccccgacatttattacaggggctacactggaggctggattgtggctcttcagtggagttactgatgtgacgcctgtgttgaacatcctgtgggggctcgttcattcctaagggatctttcagcttcgtgatctgttaatgaggcatccacgtcacgggtttagtgtggcgctcccctacttttcagtgataattaacccttgctgacactgagggggctcagctttgtcctccacccggttgaagagcacggacacccagaacaggactgtgaccttttgtagatttctctgattctcgaaaatccgatcacccccagccgccacatcttagcctctctgattctcaaaccatcgcaagcctggcagcacttggggaggcttaggctcggggagcttggtttccccacgcaggtgtggcagagccgcctccctctgcgtccgtgagggttctgaggagtctgtgctttctgagcaaactcagagtagaggcaccacccctgggggcagccctgcctctgtcctgctccgccccctccaccgcccaggcagccaggcagagctcctgccaggaccagaggccaccctacaccgacagggaaggcctggggagtgtgtcgtcctcctccatgctccctctcctgtctgagttacccaccccgtctggggcacttgggagcgggccatgtccagcacaccgcagcctccgtcctgttgcccttggtgtctcaggggccatctgcatcaccacgggtgccgtcctgggcactggggtgatgaccctgagggatgccagtgtgggcgggtgcgtgtgggcgtcccacaggtcgtccgtgtgtgcacgccgtcgcctgccctcccggccctgtgtgggtgcgtgtgggcttcccacaggtcgtccgtgtgtgcacgccgtcacctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggccgtccgtgtgtgcacgccgtcgcctgccctcccggccctgtgtgggtgcgtgtgggcttcccacaggccgtccacatgtacacaccctcacctgccctctcggccctgtctcttgcagtcttcccgaggctgctgtccatgacactgagtccagatcttcacatgaggcatgggtcgattctcgcctgcgcagaagttgcttacgccttgtacaaacttgcagcccaagagaacaggtaggaagagtgggtctcgaggagacacagggctctgtccctgatcccctcaccatgtaatcacagtgctctccagttcgagactctctcatcccttctcatttttgtttatctgcaccagtgtcacagtcgataggccccaggttgtattgatggagtgtgtaagtggccctctctcctgacggtcatgccgtgggtggaccacccacctcttcagcggggcgggtgcagcacccggatgggccgggcatctccccacggctgtcctgcccctgctgcctccttgtgcacctcctggtctcagaggtgacaagcgaggtcataacagcaaaggtcctttttccaagacggcattgagcgacttgcatgttcagtatcctttcttcatcacgttccatagtttaaaatgccagagaatatacacgtttcttttgaatttttcagttggctatgtttgtacaaataataataaagcatgaaaaacatggggtcactgggaagttgtgtgcaggaggctgtaaggcatcgactgtcgtcttacgtttcttcccagtcgagtcttcctcaagagtaagaactcccggacttaccatagtgacggcaacctgcttctcggactccagtttaagaaacgtttttaagttcatgccctgtgctggagacagttccctgggaacgggttgagagcagggtatgggcccacctcccgcccaagcctgaggaagctctggtcggccccgagctcagatgcagagtgcagctccttcagggacgctcgctcgtgtgggtgcagctgatgcccgtgcaagacctggcctttatggcgctgctctgtggttgtggaagaaggcacatggggtggggtctggggagaaccaggcgggagctcccagggtcctccagtcgggtcccacagggcctgtgtcattcccccagcagtgagatgtgaccacacctgtgaggtgtctatcagggaagcacatttgagcctcagtgcccaggctagactggggtctggccacgtgggcacctccgcctggcacgaaacaaaattccagacccccagcaggaaagcaggtgccagcgtaaagcacacggtttgcgcagattgagccagtgagggggcctcatgaggcagggcttggtccaggcccccgcatgccagcccaggtctgatctcgccagggaccttcccttggatgtcagtggacatgagctgtcgtctcagcctcacctggacctgtctgttttccaaggtggtcacattggcaggggtcacagctttaaggggatgccctaacatcctcttcctttgaccaggcactgcttcatctaaaatcacaaatgggccaggcatagtggctcacgcctgtaatcccagctatttaggaggcggaggtggggggattgttagggcccaggagtttgagaccagcctgggcaacatagtgagaccccatctctaaaataacaaaagaatgcaatgtaaaacaatacagtagaatacaaaaataatcggaggtatgtcctgcagaggtctctgggacccactgggacctgaacaagaatgagaccttgctgagcctatgctcctccgagtgtacttggggttagggtcttggggagtgtggcctcagctcctccgagtgtactcggggttagggtcttggggagtgtgacttcagctctgtgtttgaacttctgcaggcccgtcacggaccatctggacgagcaggcagtgcagggcctgaagcagattcaccagcaggtttgtgtgcagcctctgggtgtaccctcaggaggcatcacaggacctgcccccttagggcctcccaccctccccaggcagggtctgcagtcctggtggccactgtgctccatcagtcctgggctcagtgggggacctgcggtgtgatcactctgggaacaggctctctgctggcgtcatgcttgtgaacagccaccttggagggttgccctgggaggggaagagactcctaggaaatgagtgcagactttctgtgcacgtagccagcatgtccttggtctctgaggaaggcttatgaagctagtgcagtcggtggaggtttcggctgcagctggagtgtggtttccctccggggcgcgcggctgcggtcccacgatggagcgtgcagccaactctgggtgggggcattgggccccgtgctctcctggtggagttgggggcacacagaacgagcacagaagcctctggtttccagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagaggtaaagtatgaactatggatcttggtgttacaggagaatataaaaattgttcacgagggattacgtggtttacttgtctgttgtccagatagctttatattctttaagattcagctcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttgggacagtgtgagcattcagtaaattttagttgtagtggccatcacaacgtggcttttaagctctcttacaaaaaaagaaacatcagcatcctgtttggcacagttacttttctgcacaagaggctgcctgggtgggttctacgtcggtctctggggccagaatgcaggtggctccagctccctactctggccctctcctccctctctctgtgcctcagtttccccttcaagggagctctgggcctgtctggaggttaaacaaggccatctgcgtcagtaggtgggcctccgtcctcagccccctaggcggctctcctggctggcatggcatcttctgccattttctctttgttcttgtttttgacagttgttaacgtatacgtattattttaaaatttaaatcattaaataactttcagttttttattttcagctctatgatcgtcagttatacaggtgagctttacaaaaccaaagttcttatatctgtgtcctaatgaagaactgcgctgtcaggagcaggcggggcgggtgtgttcgcttccctctctgcctatgtgtgtttgggttgagcgggtgggtgtcacccggcccgctgtgggaggcgcatgagggtctgacctggttgtgtgattgggttgagtgggtgtcacctggcccactgtgggaggtgcatgagggtctgacctggttgtgtgtttgggttgagcgggtgggtgtcacccggcccgctgtgggaggcgcatgagggtctgacctggttgtgtgattgggttgagtgggtgtcacccggcccgctgtgggaggcgcgtgagggtctgacctggttgtgtgattgggttgagcgggtgtcacccggcccgctgtgggaggcgcgtgaggttctgacctggttaggttttcagctctgcaggtgtcatcgcgtttcctcgttcccaggacttgctggtcataggcaggggtgtggcctccccaaccccgagatctggccgggtgcctccctgagggtttccctctgtgcctttgcagcccaggcagcctgtctgctctgacagattgctttgctttttctagaatttgctaccgagggtgtcacacagtaggaagcctttgggtgtggtttcttccccgacgtgtctttgagatacctgtgttgctgtgtgttccgtggtgtgcatgtacggcgccgtgttatccactcaccagcccaggctcatctgggtttccagcctttggctattgtagggaagctgctgtgcacatctagacgtacaagtcttggtacgtttcacgtttcctggctgactaccaggagcagcatcgcagggtgtggggcacatgtgtgacttctcagcagccgagccaacttcccagaccctgctgctgcacgtccccatccacaagtgaccccttggtgtggtcggctctgaacgtgggccctctgggtgagtagaggcctctcgctgctgctggagtctgcctctccccagggctcctggtgctgagcctctttccctgtgctgacgaagcattcctgggtctttcgtgaagttttttgctcattaaaaagttcagactttttgctcattaaaaattttatcgtctgtcttattgagctgttagaactcttcatatattccagatgccagctctttgtcacacacaggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagagacggggtttcaccatgttggccaggctggtcttgcactcctgacctgaagcgatccgcccgcctcggccttccacagtgctgggattacaggctgagccaccgcgcccagcctcctagtggctttttactgggacttgtgtggggtagtgaacctcgtgctgttctcctttaccttcgaggggtgaagcctccctttctgcctcctagtccttccaggctgctcccaagaggtcccttggctgctcccaccagtttctggccacctcctcagtcagcagggcgggtggccctgtttgggctccaccccacacactgggcctggagggctccttcaggtgctccttggggtactggaggacccctgccttgggcctcagtcctgtactcttcacctcctggtgttggagccagcatttcatatgttgcattctgtccagttttctacttgcaggaggggacatccaaccctgccactctgtgtgggccagaaaccagggtctcaggagtgaatattttgccctccccagggcagcgcgcctgcccttgtgcaccagggtcccgctgtcagcgccagggctggggcaggtgtcccagatgggcagagcagcccggagctccgcctagcttcgctcatggtagaaccgcagtgcactgcttctctaggctggatagggggctctttctggcatctgagattagtttctataaagtaagagctgagcgctgcttggaattagttctgtgatgggataccagtcaggactagaatgtccagtaaaaattaaaaatcagcatcaccccagctaggatgggagacctctggaagatggctgtaccacgttttttcctttcttttcataaaaggttgctcatgctcagtaacacattcaactagttctcattttaatgctttttggagcctgaggttacattggcaagcatatttcatggtgttttatacgtcaagaggttcttctaattctgatgttttcattccttttcaggggtctgggaggacagctcatgagacaagcaggtaagtctgaaggcctttgcagccctctgcagccctttgccgcagccatcgttgagggaggtgtgctcgtggcgtgcagggcggcccattagcccccagggtgaagggctgggtgtgtttcttctgtggaggcggcatctgtgatgtgcttggtttgtccagtggttcctacgagggagagattgagagattgagattgagagagagaaagaggaagttgtgagctgggaggggttgcacccaggagccactggttctggaaatttctcaggaagcagaggcagctggggcagtggggccagtgcttgcctgtggacccagtggacattgcagatccctccgagcacggccccagcgtggacagagcagccctggtcgtgccctgtggactgagcagcgcagggaccaagagccgttttgggcgagcacaggaagctcaggcgggggcaagaggaaagctgagcagaggcgaagctccttacacacccgagtccaggcgaacctctgcgcctgattcccaagcctctgataccccccgggggttaggacagtcgggcattttttctttgctgattcttttttagcatgtgaggaggagggaagcgtagaacacattttagactgttccacagagtattaaaggaaaagcctgatttcatagacattcctgatggcagcagccgaccccaaggtccagggagctggattccccgacacagctcctggggccctgctgttgtggacagcccatcccacgccaccctcagcccctcgctgtgggactgtgagtgtgagtgtggaggcacagctggtgaggaagcttggaaaaatcgcggttgtgtgcagacttttgctgaggtctgcgtggtctgagcagaggagagcaggctgggattcggggaacccacggccggatgtcagggctgtaccagcctcttgtgctttctgtccacacctcccagccctgacctgatagggacctgcccgaggcctgcagccatctatctccagccaggctggccgggcttctgtactgagagcagccagcttgcatttctgctggtgttagctcagtgttctcatgagtctgatggacgtcacgggaaagtcaatcctagaaacgtgagccagtttctgtcagctgacgtcagaggcatgggactgccagttctgcaggtggtccctgttggctaagaccggtgtgtcatgttttggatgtagacttggtcattgtccctcagatgcctccagagcacacggtgcaggggtgtcacctttccgacgtacccatgggtgcccggagttgcctccttagtgggatcaagaccatcccccacatgtcatggacagctggtgacctgtaagccgtttctggatctaggagtttggcttgggatggagtggggtgtcgagtgctctcagaagggttcaatgtcccccacttcccacccacgacacgggtcgtgccctggagatggcagttggaggcagtcctacgaccttcacacgaccttcacgtgctccccgtgtgctgcggggtctgcttttagggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtagctggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatggaaaaaccgcaggtcctggagcctccgtgtggttgtcgtgggcagctttccacgcgacgtgccctccctgggcgtgaggctgcatttgcacttagcggggagagggggaatgttgtgggttctagttgggctttttgatgatgatatttggaaagacttgagacaaagtagccaccctgtcctgtcccttcctcacccaccacacccactgctccccgctggcaggcactgcaggctgcacaagtaaccgtggaacctaaacactgatgtgcttcgtccgggttttaaaaaggcgcccttaccgcggtttcggtgtttggcgtcttcacgccatccgggttctcggtgctctgctctgaaggatggtggagggctgtggtctgttgttgggggtgctgggtgcagggtggtttctgtctgcctctctctacccccaactccagctttcccaccctgccctctgctctggggcacgtgtgctgttgggatgcatccctcagggttcacggcagggtgtggattgctggggggcatcgtggagaagggcatctttatgggaggcatccctgctctgggccccctgccggcctccagctgtgtctgcaccatgagtgtgtttgctggagtgcggtgtttgcactccctcacaccgctgagtgcaaacgcggcactcctgcacatgtcgcctcgcaccgtggcgggcgtgtcccgtggaaagctgcccatgctgcccacgccctccctgggggccccttggctgcctgcactccccagccgtgacctcagctcccggcgccggccctccttgtgcagctccttcccctccatggcctttgctggccccaggagactctggcctgcaggctctgaagccggctgtgtccctggtgatcctgactgagccttggtgtcaactcaggtttttttctcctcctcgttcatttttacacttcgtaggaaattattttccctttcagctttcaagtaggaatagttcagaaggggaaatagttctgcatagcgtctgtggtcttggccccgcatctcccagtcccacatttttatttttccaaaggcaaccctttcagttttttagctgtctgttttccttgcttctgtatttctgagttctgtatgtacgcagctgtttcctgatatccttagttttagatgtgttctttcaagtgagacaagactccaagctcttgtcggggtgagaaatctgcgggttcacgggctacatgtgggagacggggaggggctgctggtcactttctcacccaggccagaggatggcgcccttacccccgaggacgccggcatgtcggtgacatgccgcccgcaggagcatcaggtgcgccctggccgcaggtgccccggaggtgtcgaaccgcagatttcttcagacgttttttgcacattttgtgggaaaagtggctcaacccttgggagtcgtctgcgtccccatatcaaagaaatgtcatacaggttggcctttgtcgtgaatattcacgagaggagatgaacatcctggatgtcctcagcgtggcctgaactgagctgcttcccccggtgccaggaagatgagcgtccccttgtctccgtcttagtctcagtggctcttgcatttcatgctttagaatcaaaggaaagaaacaggaactctgtttagtgaagcagcgatgaaggaggggtttgtcagtcagggtggactgcgttttgctcttgaaacaatccccaagtttcagtgtcttaaaaccacaggtgtttttttatcctgctcacatgtggatcaccgagggcaggggccgggaggaagggggtcatctggctcacagccttgcaccagaggcgtcacgagaatcaggaaaagttctcctctcatgccgaagacgggagggaaaccagagggactggtgagccttgagtcggccacaggtgtgtggaggatcgtgacttagcaagccggggacacgctgttaatggacttcctgctgtgggggtgagggctccgtgctccatctctgatgccctgtacacacctgccacctcccctgtcccctcagcagagacatggccggtgctgtcgtgcctttcgcttttacctgtatcttaaatcacacaggagttcattcggatttacctgtacagataccctgttctctttcttgttccgtgggaattcactgggatttacccacacagccacctgctgcttctccttcttgttctgtcctgcatttctcaccttctaagaggaccattttctctttgcctggagaacactctagtgttttccatagtgtgtgtctgctggtggcaccctctcgtttgtttataccaaaatggctttttccactttttttttttgagacggagtctcattcactcttgttgctcaggctggagtcacagtggcgcgatctcggctcactgcagcctccatctcccaggttcaagtgtttctcccgcctcagcctcccgagtagctgggattacaggcatgcgccaccgtggcaggctaatttttgtatttttagtggagatggggttccaccatgtgggccaggctggtcttgaactcctgacctcaggtgatccacccacctcggcctcccaaaggtgctgtttttttttttttccccactttgattcttaaaggttatttttgctaagaatgaaactttagtttgcatttattcattcgtttgtgttttggcactttaaagataatagtctcttgtcttctggagaggttagctgccagtctacttattactgtattggagacaatcttttaagtttcgctggcttcttttgagatttttatctttatttggttttcagcacttttaccgtgatattcctagaacaagttccctttgtgtttatctgacttggggctctagggttcatacttgttccataatctgtattttctgtcgatgttttgttcactttagaaaaattcctagccatgatctctttgaacattgctcactggcctctcctctccttttgggactcttattacccacgtcttgtctggatcaccgcacttaattctttacgcctccttacactccctcctctggttttgtcttattcagtttggacttttttttttcttttcttttcttttttttttttttgagttggagtcttgctctgtcaccaggctggagtgcggtggcacaatctcagctcactgcaacctccgcctcccgggattaagcgattttcctgcttcagcctcctgagtagctgggactacaggcatgcgccaccacacccagctaatttttgtattttttgtagagatggggtttcaccacgttggccaggctggtctcgatctcttgaccttgtgatctgctcaccttggcctcccaaagtgctgggattacaggaacattttctttgatttaaatttcattgtcacaaattctttcaggtgtgccttatctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagtttttaaaaaatattcttcatttcgaaataattatagacttacaggaagttatgagattagtaatagagcctggctgtgcttcccatgcttcctccgcggtgactccgggtatgacagtgttggagccgggactgcggtgtcgaggccctgcctctaactggactgcaggcctgtgcggtttcgtggcttcatgtgtgtgtggagtggccatgtgtgtctagtttcgtgcagattgatgccctgtgtagatttctgtaactaactccacactcaaatcagaaacctgcatccttcccacagagacagcccctgccctttgcattctcaccctgcccccctgccaccagtctgtcccttctagaatatgccatgatcgactcgtatggtcgtggcatttcgaggtgggcattttctgtgagcgtggtgccgagaccccatccagctgtccatgtgttcacagtttgtgccttcctagcccacggttgggttttaccagagtgtgttcgaccagcactcagtagagtacactggggctatttctatctgttgctgttgtgaacaaggttgccaggaatattcctgtgcgagatgtgggtacaagccttttcatgtctaccactgagtcccgtgtgccgtttcgtgagaggctgaggcaccgcttcattccaccgctgagccccgcgtgccgtttcgtgagaggctgaggcaccgctgagccgcgcgtgccgtttttaacttgattataaaatacatttaaagttcacatgcaggtgcatctccaagaaaattattttaaaaactagttaagactttcatttcccagtcctcaacacacatcagagcagtactctgttcagagctgaaaggattcgcgctgggacaaaggcgtgtcacttgagtgagtgatggtgtcacaggtgcccacgtggaagaaggtaaagtcgtatctaaaactaaatgtgagagtaactaataacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacggggggggcccagagtctcgcccggcgcttcctttctcctcccctcctctgagtttaaagaagaccctgaatgtcaggtcccagcagcccctcgctgggtttttctaacttgtggtaagaactggttttctggggttttttgtttctttttgtttcccccctcttggcatgtaatccccagctaacagattttatcataataattccacaaggtagaaacaaaaggagataattatgttgggccttatattgaagaatagaccatgtgtaggttggtagggaaaacggagattgagaataaacgtctgttctacagtcgaaaaggtaaaaagttaattagtgtacaaagactaaattgtaaaactgcctgtgacgaggtaaaggatccagtatgaaatggggcagagcagacgtgtgggcatttcatgcagaagaggagcagactcacgtggccgtggacggtgagggtgccggcctcacctcggaggcatggaagtaccaggttacttcacatcgagaggaccgttttcctctttccagtcggctgcggttggcactgaagaatcttggtgctgacagacacagagcagggtctctcgtggaacaggagttgtctggtctgttcagtttgatgagtggcagtatctgtgacgatgggaagtgtgtgtgtggtccctgtcctgtgtgcagggacgccaggtggaccgacggcctccgcatctgtagcacggtcaggcctccttgttcacggtgacaaaaaatggaaggagagtttagtccctcaggagaaatagcaaataccatgaacaagtgtgcagcaggcgtctgcgagtgggttccgttgttaggtagagacggtgggagctagagcagtgtgtggccgtgggagctgctgatgctgtccagtcgtctctgtctcgtgcgtcctggccccctcgtggctggtcagggccacgtttctggtcatggagagtgtgagtgacgagctatgtggggaagtgacaggcatgacctgtggtctggagcattgcaggtgatggctgtctgtcgcttgggtcctgagtgacaggtctaggagcagaagccgctatgcttcccgtacagcctgtcacagggacgtctgcagctccctgacaggccggcccggcttctctgaagtgcacgtgggctcacacatgggccttctgccacgtggctgggtctgcagcactttcttcaggctgctcagcggaggaggcgtcttgggcttctcatggtggttctgaaatggttctgggatgtttccagccctggcagcagggtaggttgggcgggtgaggggcaggagctggccgcacacaactcagaatgtggcaaaggcaagccgctgtggcaggcgcttttagaaaagtaacattgcgtctatcctttttttttttttttccagtgtgtgttttaatagaaaagttgtcactttccaaaatgccctttagaggtgacaccgtaattggtaagtgcttttgtttttaataatagcattttcttacagaatgacttcagattaaaaggtaaaaatgaacctgttaggatgggggcgataaacgattatagcttaaaggttcaagatattaatcggatacgttgccttgaagttgttacaagaacctgcttaaataatgggtacccaccgccctctccccccaacacaggagggcccttccccgccgtcacctcagtacccccacctcctcgcttccatgcccagggcccggcactctgggtcagttcttctcccaggcagacagtcgggagctgcagccacccaggccctcgtggaccaggagcgtgccggccgccgacaccacggaccctgtgggcagaggcggctccagttcctcagcagccccccacactgggctgccagagcacagtgaagggagcccccagggctgtggtgtcccggggctgtctcagcagcctcagaagttaggactttttttttgttaattgaatagccttcacatttgttgcttgtgcaggatctaattgagttaaagatttgggtttatattggtgggagccgggggagaccgtttgaaggaaaagatttaggggtaacaaaagaataaaagtttcccaaaatgtgatgtataaaaatttacagaatgctggtatttccctcaataagagcttacacaatttaacagccatgagaggaaggggccttagacttaacacaacgtggagaatgttcactttggcttttccacagattcctctcaaaggttaccatcgactttaagattagtattaatagaagctgtttttgctgttgtttttgatttcatggtgtttttgattgcctgggtacgctaacttgattttttgacagatggttggcaatggctgataaatgacactttgagacatctccatctcatctcaagtcactcccgccagcagatgaaggtacagtgagcatgggcgttcccggccggcgctgtggcggtgttagtgtgttagtcacggatggtgtttgtgttggcgactgtgcatcatgaggctgtccctgcagtagcctgataactgacaaatgggggcataattctatttggaatcccggatggtagcgtctacacggtttataaccagaaaatccaatacagccattggaatccgaatgtttaattttttattgcttctggctgttttaattatagttacctttgaaatactttttctgcatcaatagtaactgtgctctgttgagttccgtgtcctgtaggatctgaggtttggaaactccctttatgatgctcctgtgcagatgagaaaacagcaccccaggacctctgctcgcacacattgacctggtcatgttgtgtgggtgccagtgtgtgtgtgtgtccccggccacctgccctcccctcccgtcctgggggttacaggtggactttggactcacagagctgtaacgctgatctcattgcatagataagaaaccatgggcccggcgcagtggcgggtggatcacttgaggtcaggagttcgaggccagcctggccaacatggtgaaaccccatctctactaaaaatacaaaaattagcggggcgaggtggcgcgtgcctgtaatcccagctactcaagaggctgaggcaggagaattgcttgaacttgggaggcgaaggttgcagtgaaccgagatcacgccattgcactccagcctgggtgacaagagcaagaccctgcctcaaaaacaaaaacaaaaacaaaaacaaaaaaaaccatggttaccaacgttgactaggttttgatattgaggatgaagaatggaagtacatttaggtgtcttgtaattctctgacttcctccatgcttagcatttctttttccttagcatcttcaattttcttattttttttttcttaaggaacttgaacattctgtaggatccaagtaccgttctactaattgaatttgaatgcatcatgatcagtgcctcaaaattttatttcaaaagtccatgattaattcacactggccatgatgctggtgcactttgcccctgggattggcacaggtggtgactcgtggaatgcagcaccctgtagacgacgcacctcctctgctcatggcccccacctgccccgcccccagtgcctctccaaggctgctctgttggcctcggctcctgggcttcgggggagcggtggaaagaacacgtgggtttggtgtttgccacttgctggctgtgtggtcacgagaggctcctccgtaggtggcagaggtgggggttcgaggagacagtggcactgagccccgcacgcggcgggactggtgactctctgcccgctcctgctctgtgcagcaattgccgtccctcccaccacggttcctggtggccttgggatgggttcccgggggtctcctgctgtccggccccaactcctgttcccagtgcgcccccggagccctgtctctctaaatgaggctgacgtggcttggcctgaaggccctgccccgttactctgggtgcatagtgtatgcctttttcttcataactatttctgggaaagaaaaatatgctccattttattattgttccatattagaagacagacattgtggaaggaataatcaggttatccattcagtttcttagttgtagtggtagtaaagtgatgcgtgtatctgacagatgatggtgagcaggcgtgctggaaaggagtagcatgacttaggggttcttttggtttggttcgaaagtcattgctgtgccgagatctcagggtgacccgctgtgtccctggtcaggtccttctctgacctcaagggtgacctgctgtgtccttggccgggtgcttctccaacctcagggcgacccgctgggtccctggtcaggcaggggctgctctgacctcagggtgaccacggtgtccctggtcaggtgcttctccgacttcagagtgacctgctctgtccctggccgggggcttctccgagcagagctgctgtgcgctcaccgtgctgcctttgttttaggatgcagcagtctcggccctggctgctctatgcagtgaatattacatgaaggagccgggggaggcagatcccgcaattcagggtgagtggggagcccttttcttgaagactccaggggcttccagcaggaagctgctggggagtgtctgggcacggaggaggcctcggttgtgcagtggagcagagccaccacgatcatggctggagtgggactgttcgggtctcaggttcccagccgaggagctgtgggcaggtcctgcagctgcccaggatgttgcatcagctctgaacaggtggctcagcagggacgcgtctctgttgacggcaccctcttgctccatcacccaggctggagtggtgtggcgtgattcggctcactgcaacctctgcctcctgagttcaagcaattcttgtgcctcagcctcctgagtaggtgggactacaggtgcctgccaccatacccggctaatttttgtatttttagtagagacggggttttactgcattggccaggctggaatcgaactcctgacctcaggtgatccacctgcctcagcctcccaaagttctgggattacaggtgtgagccactgcactcggtcagtgtttttagaatttttgtatgcaccgtgacatttttctgctgtgtgtttcactcgttaatacattttgctgttttttccttctttatgaaagtagcattaggctggctttacgccgtgtcccgtgcgtagctgctgtgccgcctcactgtacatcctgcacccccgtgctgaagttcaggcttgcttctcgcacatcatgttcgagggatctgcttcatgaatcgtacttttatttttaaagtgtcacatgcacatatgttggcccacagtgttcctttatgtcatatgatagaacatgcattattaatcacgtcaaaagtgtgtgaatcaccacttaaaattattataagtatataaaaatcatgcattagcttggcatggtggcacacacctgtaatcccagctacttgggaggctgagtgtggggttgaggctgcagcgagctaagcttgcaccacggcactccagcctgggtgacagaatgagactctctcaaaaaaaaaattctctttctgattcctattttgaggtaggccactttggaaacgtgtctgctttgggaacctcaggcggctcctcctttgttcactgtggctttgctcctgtttggggcacacgtcgggtgtggctgtacacgatgggcagcagagggcctctcttcacactcgttgcttcctttcagaggagctgatcacgcagtacctggctgagcttcggaaccccgaggagatgactcgctgtggcttctcgttggccttgggcgcccttccaggcttccttctgaaaggccggctccagcaggtgaggctggccacgcgcagtggacggggcctagggcgagggtgtgggagcctcgtgtgttggggcatgaggtaggcccagccgttaataaacccatcagtgcttgtagctgggagggggttcctggaaaccggcacctgtggccaggaggaagggggcagagggcacccaaggtctgtggccccttagggccctggcgaaccctttgctgtcagaggacagacttgaaaaagctgaattctgggagggaggagaaggtgttgtttgtagaagcagctgccgagagtgaggagaacacagttgcctttgtgcgttgtggagccgggtcctgttttggttgcggccgtgcatcctgcatccaggtcggggcagaggtggttccacgtcctcccagaggtcagccccacgctggcctcagtgacctgctctctcacgctttcctgtggtgctggtcccactgaccaacctgccgggaactcctgcttgtctcccctccggccacctggcgtctgaagctggaataggccctggccactgggttccccacgcccttccctccccatgggatccagccttggcacttcaggatctgcagctccagacggactcctgcctgtgtggcgggtgggcctcgcagccgccatgccatctaaaactcgcatgtgggggtttatccagttgaaacacagataaatgtgaaacaggatcacttggagatatgacagatgaggttgtcgggacccagcagcttcctttgtcaataccccaggtctcagcgtaggacaaaagggggggacctcaggtagggtgtggccagacccccagtgacaccctggggtgggggctggccgtggagaggctggaggtgacctctccccgggtgtccttcctgggttgtactgggggccgtggagaggctggaggtgacctctccccgggtgtccttcctgggttgtactgggggccgtggagaggctggaggtgacctctccccgggtgtccttcctgggttgtactgggggccgtggagaggctggaggtgacctctccccgggtgtccttcctgggttgtaccgggggccgtggagaggctggaggtgactcctccccgggtgtccttcctgggttgtactgggggccgtggagaggctggaggtgacctctccccgggtgtccttcctgggttgtaccaggggccatggatggccgtgaggaaggtggtgccaggagctgcctatctcatggtgtggggtctgtggctccgggccaacattgccacctccctaaagagtgcactttgttatagcttatggttcttctgtgattctttattgctttccaggttctcacaggtttaagagcagttacccacacttcccccgaggacgtaagttttgctgagtccaggagagacggcttgaaggccattgcgaggtgagtcccaacagttcctccctaaagtcgtaagtctctgaaaggccagcagatgaacgctaagggggatgtttttgctcagaggcaggacttatgattcttcacttcctaggtttcctctcttccagaggatcgtcagtcccagctgctggaggctctttcattctcttgctgtcatagtcgtagtgaatgttaaacttctttagggacactgggccccttggagaattggagaatgtgtcctggcccaaggttggcaaagaggagctgaccctgccagccagtgtttggaatgatctctgcactcgttgacagacacgcacctggggccacgccatatgccctctcctccctgcaggcacacaagaggagcagtcccgcgggggccacgcacgcccccttctctcctatgccagcatccgttccctctagtcagggtgggaagtgggagggaccagccgcagggggcgtccccatccacctttcaaccggagagacggcagagcgtgacctcggggaagcacgtcccacgttccatacatgtggaaggagctctgtgtttctgatctacccgagggtcctggactgttctgagcgtgtcttctcaggatcaggaacacacatcagccctctgcgatgtggaagatgaggctcaccgatgtttgtttgttagctcacacattttaaatttcaggatttgccagactgttggtgtgaaagcaggagccccagacgaagctgtgtgcggagagaatgtttcccagatttactgtgcgctgctgggctgcatggacgactacaccacggacagcagaggggacgtgggcacctggtacgtacgtagcagtgggtgagcgcttcttctgagaagcccatctattccgtggaaactcggaggccccgggcttttctgcagggagaaatctttgtagatttgtgccgtgttttgcgttttaaaggctctggggaagatgacctgttctctgctcccgggtgagcctgcgtggcagggctttgcaggtgcttgtccagcccgtcctcaggtgttgggcctgtgtcgtcctcgttgacagggtgtgagggaggacgcgtcttcaatgaaaggctgccggctgcttacattgggttttgccaacatttcttgctgtagtgggattgataacccctgaaacgcctgtgtgtgtaggatgcctcggggccccggtgtgtgtggctgtgggtggctccctgcacacgtccctgtagcgcacagggaacctctgcaggccccgtgactccctggcagcgtgcctgggctctgtgtggggttagtcacgggtgtcgaattcacacaggctgccggcgtggtgggcagaaccagggttggaacccccctctcaagctgggtgtctctgcctctccttgtcccatcagggtccgcaaggccgccatgaccagtctgatggatctgacacttctgctggctcggagccagcctgagctgatcgaggcccatacgtgagtgtcacgtcgcagctcttctgcatcctagagggcagccccgagcttggggaggctggcggggcgggcggtcctggtgctcagtggcatttgcactgctgggcacacaccctcctcccagagagcctctctggtccctgaccccaggtttgtgcaggcccctcctcctgcccccatagccatggcgtgagctggggcccatcctcctctgcccagtgcccccaggacgaggctctgctccccagcctgggcctccaacggtgctctggccagtttgatgacagccagcttcccggggtagggccgggcaggaggtggggacttctcagcttaggaccctgaacctgggggtctgctcctgccaggaccagctgagccatcactcagttccctgcacctgaggctgccattggggcctgcccttgctgtgtgtctctgtcgggggcacggggttgtgggtacccccaggccctgccctttctgtcggtctctctgtcgggggcactgagtcatggaggtccaggccctgcccttgcggatctctgtcaggggcactcagtcagggggtccaggccctgcccttgcgggtctctgtcgggggcactgagtcatgggggtccaggccctgcccttgctgtcagtctctctgtcagggacactcggccgtggggatcccagggcctgatttccttagttctcacctctttctctttccccctccccatctcttccccagccccagcttctctctccccatccccggcctctctgtccccatcactcttctccacccgctcctgtaatcctatttgttgtccctgcttcaaccctaagacctcatcagcacgcatgtaacacgtagcacatgtgtaacaagtacgtagcatgtatttgctgcgcacctgtagggttgggctcctgggatgtgaaggtaacggagtgtggttcttccgagccagtgtcctggtgtcagctgccaactcagccaccatgtcccgaggagcccgcatgtcctcgtggtgcttgggctggagtcacggctcggaccgcctgtgctcagtttaccgcccgctcttaatttaccgcccgcccttggtttacctcctgctctcggtttgcagctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtactgtcggggtgtaggccccccgtgctggccccgcagccatggcgagatcattggcagcccggccttgtctcactcactctcttgcaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcatgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctaagtgagggctcaggctgagctgccgttgccgagagccttgtgtctgcttcgggtgtctgcactgtgagtggctccgtgctggcgtccgcaccagccgcttggggccagaccttcgcgtctctgcagctcggagcagttctgctcttcagcagatgcttgaccggctgtagccaagcctgaggggtggcaggctcgggggtcccactgccttctgaggtgtctccgtgttgcagatccggcactccacccagagcctctttgagtacatgaagggcattcagagcgacccgcaggccctgggcagcttcagcgggacccttctgcagatctttgaggacaaccttctgaatgagaggtgagtggtgtctcttggggcctcagaggcgtgagtggtgctggtgcctctcaccacgttcccacagattcccggggtctcgcagggtctgtctggggtctgaagggagaagcgagacacacgctgtaccagttggtggctcagcgaggaagatgtgcctgcagcatatggttctccgggcggccaggcctcagcccctgcgcctcctcttctagcctccacatgaggcagggaaatgaccgttgtgtgtacaatggacgtaaaggtagtatgagtacaaggtggtccctgtgtgtaggaaggcgttgtgggagctcctccagcttggtgctcccacggacgtgcttgcggacgctcatcagccacccggcaagtgagagctctgtgttcctgaggatggaatgtcaagtgagaaacatcgctgctttctagaagtttctggctttacatggaggcagagtatagaccctgtgggccttgacctcagaattgggaacatcctctggaagggttgttcccagcatgtgcgaggacgaggacacgggcctggtgtcccctcgggcggggcctcggcagcctctcccatgagagcacagatgccgctctcggcaaacaggaactcggcccagccatgttttcttttctcgttacgactataatcagctgcacataaaggggcagttcgatcgattttgataggtgtccacccttaaaatcttccccagtcaggacggtgggctccagcccaaggtttcctcccagcccttcgagtccgtgcccctgacctgcgtcaccatagcctcagcccatggtcacttgaggcgctgggccgcgtgccggtcgctcattcctccgtgccggtcgctcattccgccttgccgttcgctcattcctccttgctgaccagtcgtgtctgttggtggaggcaccacagtgcatctgtctgtgggcattttggttgttgccgcatcggggctgttgctggtagagctgcaggcagtctgtgtgtgcgagcctgtgggtaggtgtgcacagctgggcctccctctctgtgggctgcggagcccagctctcctgtgtgttagtcggcctgtgctaaagctctcctgatgctcctgtcgcccagaggggacctccccagcctccttttctgtggggtaaataccgaggcgccgcaggctggctcacacagaggcgaatgtctagctttggaaagctgctggagggtttccagaacgcccacgtgtcatgtctttctgctgatgctgtctgaggtcactctcactggcgcgttgctgttttatattctctttggagaagtgtcttcatttttttctgttctccttccctgactgttgtggtctgatcctcccttgtcacacatgtgacttgagggtgttttctccctgcctgtcctttcacgcaccgagcgggggcctcacactttcctcacgtcccagcatctccccttgttctctgaggcacagatttttctggtgtgtctaagacagcttgcctaatccgtggtcactgagattttctgttttgtcctagaagatttatagttttgggttgtgtatttagacctgggacgcgtcttgagtgaggtttcttacatggtatagcgtcggcacaggcaccttgacgcccagcggtgcccaccccaattgctgggagggctcccctctccgctgcattgccgttgcagctttgtaagaaactgtgggtttactttggactctcctgtgcccgacgtgtttgcttcactttgcaccagggccgtgctgtttctatcccttccactttaccatcattttcgaagttcagcgtcagcctccagccttgtttcttctttccacagttgttttgtcttttcctgaagctttgcgtttccacgtaaattataaagggggcttgtcgctttccactgggatcctgctgactctcagccattcagggagttgggcgtccttgttgctggtgtccagggtctcacagctccttctcccctcagggtgtccgtgccgctgctgaagacgctggaccacgtgctcacccacggctgcttcgacatcttcaccacggaggaggagtgaggctctgcttttcatgacttcctttccgattaagcctaagtagctcatgtattaaagaaaaagtcatcagacacagagatcagaattccaggaaatgatcttccagtgcgttctgggtcagttatggtgactgtaaataccgtcatcacagctggccctcaaaataacgcaataataacatatttacataatgacatattatgactgtaagtgcagtcagccccatctggggctgaggcgggggccctgctgtgcactctccccccagctatcccaccgggccaggggtgggcctcagggttgtgctgggagccgcagggcctgaaggggcctcggctgtacggggatgagactcgcaggggagagggcagaggccggtgacctggcgaggacttgcccaggagattggagctccttgcttctgcgccacgcggatgccccaggctggtctcagctgggttgttggctctgagtggtcatctcgttgctgccatattttcttgcttcattgaatttcaccgtgttgggccagtctttttttttttttttttttgagacagggtctagctctgtttcccaggctggagtgcagtggcacaatcacagctcactgcagcctctacctcagcctcccaagtatctgggactacaggcatgcgctgtagtctaatgtacggctaatgtttgtatttttagtagagacaggatttcactatgtttcccaggctggtcttgaactcctggccccaagtgcctgccttggcctcctaaagtgctaggattacaggtgtgagccactgcgtctggcctggatatatttgtatctggggcacgttgggtcatccggagacagcgtggtctgtttttgggggcactgctttttttttgtttgttttgagatggagtcttgctctgttgcccagggtgtagtgcagtggctcgatttcagctcaccgcaaccccgtcccgggttcaagcagttctctcgcagacttctgagtagctgagattacagctgtgcaccatcacacctggctgattgtttgtattgttagtagatacagggtttcaccacattggtcaggctggtctcgaactcctgacctcaagtgacctgcccacctcggcctcccaaagtgctgggattacaggcgtgagccactgagcctggcttgggcgctactcttaagctgtcaggtggacccagagctgtgctggtctccagggttttctgcccctttaaggtctctgctccctggcgcttcccttcccaccgctgctggggcagtgccggggcttctggccatcttttgggtggttcgtccccagccttggacagcgtcctcgtactcaggtactggctgacccaggcccaggttagtcctcagcggcccccaggaagccccctctggtgctcagaacctgagcgagctctgcagacttggaatttcccgcttctcaccacgggcttcccgctggagtctgccacctgctggacttggctctgccttaaccttcgggcgggaggcagatctggtctctgttgctccatctttgctggacgctgcacatgtttttaaatctaacagcattgaagggtttccccttttaatttcttaatggggcatcactgactgaccttcttacacctgctgttggaacagcctccatgttcacaggtgcacccagctcggttgtggcgtattatcctttaatacaatgctaaatactccatttaaattttttttttgagatggagttttgctgttgttgcccagactggagtgaattggtgcgatctcagctcactgcaacctctgcctcctgggttcaagtgattctcctgcctcagcctccctagtagctgggattacaggcatgtgctaccatgcccaggtaattttgtatttttagtagagatggggtttcaccatgttggtcaggctggtctcgaactcccgacctgaggtgatctgcccacttctgcctcccaaagtgctgggattataggcgtgagccaccgtacctggcctaaaatattgacatatatttttctggcttaaaaatttcaaaataagcctgggcgccatggctcacgcctgtaatcccagcactttgggaggccaaggcgagtggatcacttgagctccggagtttgagaccagcctggccaacttggtgaaaccccatctctacaaaaaatacaaaaacattagccgggtgtggtggtgcctgtacggcttgggcctgggaggcgaaggttgccgtgagctgagattgagccactgtgctccagcctgggcaacacagccagactctgtttcaaaaaaaaaattttttttccaagataggatggtagagaaaatacctcctgccatgtcctgctatgaatacagctttgtatttctctctacagttttgtcagttttggcttttcagattttgaagcgtgtttgtgggctgaatcttgcccttatcacccatttctaggatgctttttgctccactcattctttgtcttgcttcacttgactttgaactgtatacttttttccatcgttttactttcagtatcttcatacatgtatgtttttgtacgcctctcttagaacagtgtatggttttgtaaaaattcagcctgtagcttttacctgcctccttcatgacctttataatccccttggttctcagcctgccactcacaggacttttccctgtgctgcgttcccagtgccccctccccgcccccacctgtgctttttgttggattagtagaattgcttttgtcattccattgttttcatatatttgtttgggacattttacttttttctgttaacgcttaccctagaaattagaaatgacaccacgtattcttagcgaagtccagttttcagcattttgtccttattggacaatagcaaggatattagaacgtgttggttccgcgtgcttccgtcttgagttatgtgctgctattgtcggatattttgtcttagatgtacgtactttcctgttcattgtggtatgtgtaatttgcgttactttgaattttccacgtttttactttctttgtctctcatcacttactgcttttgggaccccccccatcggggttcacattccctctccctagagcacactcccttggatttcctcgagtggggtctgctgcggtgaagctttcccattttatgtgcagattattttcagagggtatatagaattcaggcagctgtttcgttgtagcacattaaaaatattttcccacttcctccttgcttctgttgttgcttttgagtgttacctctgagtctgcctgtgctccctggaaacggcccgggtttcccaccccctgcccaggtttgctccttccctggtttttctgtcattatcacgctcacgtgtttccctcggtcaccccctctgcaattttcacacgtcttttccctctctctttgcttcattacctttggcccgcctgccagctgctgattctctctgaagatgtctctaaatgacttttaactgtgatttgtggaattcttattgtggagttttgcgtcttttcaggtgtaggttttttgtctcgcgtgtttccacgtctgcttgtagcgctttccgcttcgccgttccctgcggcccttccttccgtgcccggtgttcatcctcttgaatgctcttttcctgcctgtttggctgggtgtgtctgagttgcaacctgagcgggtttctttgtcttcttacttgtctggtattgtgttctctcgggacgttgcgtttgaggggtcgcacctcagagcaagccgaggtctgggctaagcctgtgctttggcaggcaggaccttagtttgccttttctgggcacctgaggagagggtagcagcagcctggggtctccttgactcacggtcagcagtgagggtttcctggcctgttgggtggctggagcttggctgcattccccactgagagagggaggtgcgcaccttctcctccctggagtggccttccaggtgccctctcagagctgctcatcagggctgtgcctttgtcagcaccaagcctcagcccttgtccctgctgccactgaaggctcaaaacaacactgcacagccttgtgtgtcctctgtgtgtcggcagtttcccccggctctgcagcagcccaggccaggtagcctctggagggagtggtggaggagcacgggcatcctggccgccgctgtgttggggacagaccctggggcctggaaagggaggtggggccccgtgggggctgctgcaccacaggcaagagagcaagagacagcagaggccggccaggtggtggcacagccgctagggaccaggccggcctgtggaggtattgggatggggaccagcggacttgctggcagaggggcctcagggctgcaggcttcttggactgagccactgggaggacggagttgaccttctttgagacagaaaaagtgtgcatcccggggctgcctgtgaaagctcatctctaaagtgtgtgttgttcttccagccacccctttgctgtgaagttgcttgcgctctgtaagaaagaaatcaagaattcaaaagatatccagaagctcctgtcaggcatcgcagtgtgagtttcaagtgctgctggccttagacggaatggcagggcgcagcctcccttggctgagggcaggagtccacggctccaggcgggagaggagcagttagtgttactcctcaagctaacctaagatcgtgcattccaatgttcaaagcagtcgcaatgggaggtgaggcagcccaggtgctggtggagggagttcccgcgggaacaggcgagctctgcctctgctgccctcgcgctctgccctggcgggaggggaggctccggaaaggagctgcgtggtcaggggctgcctccccgattctcctgtgtgccctgggggtcgctgttgagtgccttgctctgcggcgctcaggtggacactgggcaggtgcgccagccagcgataggcaccttggctgctctgtggctccttgaggtgggggtcctcatggcagggcgagcggccctgcaggagatcctctgtgaggcgtcctcacttcccacagtgactttccaagtgcgacactcgtgtgtgtaggcacagtgcagatgtacgcacacacacacctccggcttggggccccaggcccgcactgtgctcacggatctgctctgcccaggtctctgcatgggcctttgggtccggggtttgctggggttggcctgcgcggggtggggctcacctggagccatgtgctgctcccggcaggttctgcgagatggtgcagttccccggcgacgtgaggaggcaggccctcctgcagctgtgtctgctcctctgccaccgtttcccgctggtgagtgcctgcccctgctcacgtgtgtttgccgtgtggacacaagcccctcagtgacaagaaggccttcgctggcactgttgtgttggtgtgctttccagccgagcccctctcgttaacgcgcctgggtgacgacgcgtcacaggcacgcggctgccaaggggctctggacgccactgttctggctttaaggacgggctgtccggctggcgtttctatggacatacattgaggggtgacctggcggtgggatctggctcaggagcttccagaaggacccaggctgaagtggttcagccacacctaggggcagtgcccttcatccccagcactccccggctattagatttctaggatttcttttctcctggctgcaaaaaaaacctcagatgatacaaaggtgacattttcctaaaaggcaaaagtaacttcatgttgtatggtggttctcgaagtggggtgccggaccctcaggcttggcacctctggggcttcagcagtgcagctcttgggccctgtgctgccgactcagcacctccagggtgggcccggggctcagaccaccagcgcagtgagacatgatgaccagggcaccactcaaaaagagagcaggcgagattgcttccctgatgaaaagagagcaggcgagattgcttccctgatgaaaagagagcaggcgagattgcttccctggtgaaaagagagcaggtgagattgcttctctggtgagggagcaggttggttaatagatagcgggcgagattgcttctctggtgaggtagcaggttggttaatagagagcaggtgagagtgcttctctgatgaaaagagagcaggcgagattgcttctctggtgagggagcaggttggttaatagcaggcgagattgcttctctggtgagggagcaggttagttaatagagagcaggcgagattgcttctctggtgagggagcaggttggttaataaagcatttaaacaagaatgatgtcatcttcactgctgggatcctgcagctagctgtgtgtctgtggagggaggaggtggttaatgggcctggaaggcacctcctcttggttgcagccctgctgtggctgggatgggatgcagggtcagcgtcctcctcctgacgccttccactgacggggctccctggcctgggtcctgtcgtctctccggggtggggcggtggcgcttccctccggcaaatgcactgcatccctgtcccagatccggaagaccacggccagccaggtgtacgagacattgctcacctacagtgacgtcgtgggcgcggatgtgctggacgaggtggtgactgtgctcagtgacactgcgtggtgagtgaaggcccttcctgcacggccacctgggcctggcaccgcccctcttcctgtccccaccgtgtctactcgtctctcccaaaaccctctgataggaggaggaaagagggttcccaggtctccacatcctctgcttaggttttacaaggcagccgtgctgctgtagccgaaacctcttctcaaccgccctgtccccaaacagtgtcaggtgtcaggaacacagcaaagccatccatcccaccaggggagcgggcacctgtaccacaaggctgtgtctggtggcctgtggagcagagggcactgaaggcctggcaggtgctgctgccccagacctctctaaagttctcttggaataggccgtgtgagcacctgttggaaatcaagaggcacaggcggaaataagaaaagctctccccacgcctctgctctgatgtccacccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcacttgcacgcgcgcacacacacacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatcaacagctaaattaaaacctggaaaacccttgtcagcccctccttggcctcgcttggtctgtcctcccgcagtccctgcgctgggcgtggtccttcccgaggggcaccccttgttgggaaggaaccgtcctcctgcgattccggaaagggctcaggctcgaggctctgctggagaacgtgctcctgtgacgtcttttctgccctcagcctggctatggatgtcgggggtgaggtctcctttccctgactgcggccatggaagcttgacgcgggacctccgcacacctgaggttctccggtgggcactcgagagactcacggctctccctctcctcacagggacgcggagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttctaaagtaacaaaaacaagtacctcagttctctcgggggctggggcccagggttgctgtgctgtctctctagttaccagggttggctccttcctctcagcctccttccggcaggaggttatatctgagagggaggaggagaaccatgtctagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccgagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacacgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagatctaatggaccactatataaagctgggaccctaaataagtctttttcaaaggaacagcagcaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaaatgatcaagaagagattagaaaaaaacagagcccctagaaatgtaagaagtgaaatgaaaagctcaatggatagcttagacacagctgaagagagaattagaaaactggaagatctgaaaacattatccagagaactggaagatatgacagcaacatcaagagacattgaagaatgtctaacctttgggtaattggggtctcagaatgaaatgaaatgatgcagatattccatactgacatgcaacagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacaaaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatggcttatatgtggatttttttttaaagcacgtagaattgcttaaaatggacaacagcagcatataaatcagtggcagagttggtggctgaatttagagcatcttaagtctatgttctcctggaacagagtgcagataattcagttatcagcttggctaggtgcatgttgaagtatttagtcacacacaaacagttaatgtatggggaagataacttctatactagtaggagagaaatggaacaagaataaaaaatacactatcaaaatatgcaagaatggcaagaggaaaaggcagaacaagctgcaaaacacacacacaattagaaataaatattttgggacacaataaatgtgaatggattaaaacctctgttaatgacaaagttctccagttaaaggaaggcaaatagtgttattaggaatagattactatatgatgattaaaggctcagttcaacaggaagatgattgatagaactttcctacatttgtaacacagtcttagaagatactaaagcaaacattcaagaagaaattgatcacctactaccatagtgtattttattgaattggtacatttcaataaagtgtcataaggcacggttgaaggagaaaaacttgacccaatggacagttacagaacccaagtgtgtgtgtgtgtgtacacagaaattttaaaaatgtttttaaaaacatctctttaaaagaaataatgaaaattataaaatatataatgaaagataaaagttaatcaaaacagatagagttcacctaaagtggtgcttaagcgattctgaagtcgtgaattatacattacagaagaaaggctggaaattaatgagctgaacataagcagaggactaactgtaaagaaaattagaataagagcagaatgaaaaggaaatgaaacataataaagaaacaaacccagatggttcttcggtgaaaagacccacctgggagcagctgccatgggtccgtcagctgaagtgaaggaagtcctggccctcctgcaagtgcagtgacctcaggttgtcctcaaaggcgccccctgtgaggtcctgtcaggagcagcagattcagctcagtccggtctcctggctctaggaggccactgtggagcctcctccagggccaggggttgggggtggcctgtgtccacctgtcaagtgttctgctcctctgctaatagcggagaggctggaaggagacaaaggccagagagggcagcagccggcactgcttgtaccacaggccctgttggtcaccagaggggaggccccccctgccttctggccttgcctctctacataaggtggctgactctccctgggggcactcggaatggaatgagactaacaggcaatgcctctgctgtttgaccagggcagacccaccttccctccacacacccacccctctgcacaggccaggagtgggaggaggcccctcagacagaaactgcatctcagaaccatcaacagctgcccctgtctgatctcctctggcctctgtcatccccacccctgcaatggagtgagggctgtgaccccgggtccctggatgcttaatcttgtcctgtgtgctggccttggccaggtcacctactctcctgtatgaggccacagcaggtgtccagaaatgcctttcagacgtgccctgcaccccagcacctcctgaacaagttcctgaagacagcccggcagagtggtggacacaagtctctggcctctggcaggacagaggagggactatgcattcctgtcacagtccttggtccttgggcccagcaggaggaatcggagcttggctgcgccccttacccccaccacatcagaatccattacaccacctaccactgctgtcactcaaatgatgctgtcactcaaagccatccttcctggaaaacatttccacacactctgccgctatctgtccttcctcccttgtctctctgctctagagtttgcaaaggaaacacacctgagttcagggaccaggccagcccagtgcgtgttgacaccgtcttaaacaagactctgttaaaactagatgcttctgtaaagcaacatgttccattaggagaatgaaaaggcaaaccacaaaatggaggaagacatttgcaaaacattaaaccaacaaagtcgagcagccagaggtgtaggggactcctacaggtcaggagagacgcagcgtgcagtaggccggtggggaaccctgatgagaaacaccgccagagaggaaggaactccagtgtccagcgggcacggggggttgttggtcagactcacacctgaaaccaccatgagaacacactccccaaacggctggcgaccaagtgcccagcccagtgtgagggagccgagcagctgggccctctggctctgggcatgttcctgggcatcatccagagaagctgaggatgcagccacacccacgacctgccttccactcccaggattagacccgaggcagggatgctcacgcaggaggacacagcgtccttgcaagggcaaaccgggaaccactgcccacaggcctgggtcctggcgtggcctctgggtggggtggcgtttgcacacgggacgtggagaaagtccacaccatgcacagcgatacgcacacaccccaaacacgtggagtgaaaaccagatgcgagaacacagacactggattctgctcacatgaactacaaaaataggataaattagactatggtttagggatgtgttcacgcacacgccatgagggttggccctgccaggtgccaaatgcacgttcacaaccaacatagacggcatttcgttcctggaaaagcagtgatgtaaacgatgttgggacaattatccaaatagaaaaattggcatctgtaatcaaaagaaattccagttgtatcaaagatgtaattaaaaactagaaatcccagaagcaaaatgggacaatgttgttttttaaatttcacaaccaggagtgattgtcttagaatgaatcagactccataaatgaaagtcacttaatttgattatatcacaatggcaaaaatacaaaaatatcaaatggcaggaaaatttgcagcatgtcggagagttttccttatgaaaaatactgaccaatagaaaaatgggctaatgaaaataataatttactgaaggggaaataaagcagtttataaatatgtgagaagatgctttccctccctttaagggcacgaggcaggtgctccatcgctggtgggttgggttggcacagcagctgcgggtggtgaacagccagactgggattgaatgtgtgtgctctttgacccagaaatttttagaatttattccacacagagccacttgagcgaaattatgtatatatacaaatactgcagcagcattttaaacagcagatgattaaaaatggccaaaaggtacatcagtaagtaactgtatcacaaatgcatgaaacatccatataatcgaagagcgggtgttttagtgacaaacgtgaaccttgggtttctctttactcttccagctaacggtggaggaaggcacaacaacagtgccaccgaggtgccctgagacccgcaagctgctcccgccaaacggaattgcaggggagcctgatgcggcctcggtctgaccacctctcaaaaggatggagcagaacacgcaaaaccacagggaaccggtcggcagagtgcaggatacacaagcccattcttcagctgaactaagaaaagagcgtcggcgtcagggagacagaaaggtcatgtcgtaaaggtcacacggacgctgccgggttccagcaagcaaacttaaaacatgaagcaatttataaggcaattaggaagatttgaacatcgatgggatatttggaattctgtggtgggatggtggttttatggtccttttaacagtttttatctccttgagatagggaaataataatggatgaaattaggctagaatgagtgccacaacaccagcgtggggatttggaggtgtggaggacacataagatggacacgcttgctccagggatgggtacatagggctggtttcctgtcactttgctaatatggctcaaataagctggaaatttccctgaatagaaaagtcacagcaacagtagagcccgggggctccagcggcttcacacggaataacctccaatctacacacgtgaaaagagcaagagatggaacaagcatgtgctgtgaggccacactgccagctgcccctggaagaacaagcaagagacaggtgaccgtgggggctctgggccctccaaggacacagcgtgtgcaggacaaggaggaacctcttttcccatgctcagccggctccctgggaagggttttcaccaagtgccttggggttcatatgagtgccccaagatagtagtgacaccacaggtcaccataacacatacgataacagtttgacatattgcgagaattaccacaaggagacgtggagtgggcatgctgctggaagagcggcactgacggggttggagagggggtccctgagaagtagatcctgaagaggctgtttctgaaaaactaaaccagattcgtgtagaatttgcattttataactgcttctcggagcctcccgtttactcacctaaatgtccccggtaacttggacaacggttattcaaaggttttcattactttgctcagatccatcagagcaatcactatctttggcggctacggccttagaaaacgtctttctccaataagactggaaagttggaatgactcctggacccacggtctgcagaacggatgctgtgtcagcacaaaaacacgaacccctcgtacatcagcctcagagctcctgggtgaccaggtgcaccgtcaatgagcagtcgtattttgaaaggaatctccttttctgagcactgggcctaacggtgggcttacactattccatcaaccgtgctgtgcacagatgtgctgccacctgggccttgccgttccatttctagagccacaggcagagcagatttagcctcattcctaagaatcctaggattctcagaatggcgaccactgccttcaacttaacccatttatggctgaggttgcaatttttcgaatttttgcaatcagatcttggcagtgaccttaagcagaatataaacttgcacatgcttagcgttccaataatggaacactaggcatagatgggttttaaagtcacggcaaagagtcagactgtcttttgaagctctgaagccaggcattgacttctccctacctatgaaaggcctgcatggtgtcttcttccagttcaaggttgcttcctctacactgaagatctgtggttgagtgcggccacctccattgtgaccgtagcatgatcttctggagagcctgctgcctcacctcacactcatattacggagacggcttctttccttaagccttgtgggccaacctctgctagcttcaaacttatgttcacagcttcctcacatcattcagccttcacagaattgaagagagttgggacctcgctctgtattaggctttggcttaagggaatgttgtggctggtttgatctgtcagaccactaacactttctccctatccgcactatcatttgtgtgttcactggaggaccacttttaatttccttcaataacttttcctttgcattcacaacttggctaaccgttaggctgaaagctgggcctctcctgccagtcgtggctttcgacatgccttcctcactaagcttaaacatttctagcttttgatttaaagcgagagacgtgcgactcttcctttcacttgaacacttagagtccactgtggggttattagttaacctaatttcaatgttgtgcctcagggaatagggaggcctgaggaggggtggggtgggggggagcggggaggcgacagctgctgtcagaacattcgcattttatcaatcaagttcactgattcatatgggcgccccgagatagtagtgacaccacaggtcaccgtaacacatacagtaacagtttgacatattgcgagaattaacacgtggagatggggagacgtggagacgtggagtgggcgtgctgctggaagaggggcactgatggggttgctctcgtggggctgccacacgcctgtaatttataaaatgcacaatgaagtgcaataaaatgaggtgcgccagtagttgccagaaagctgtgcccaagaggctctgctcacgttgttctgcctggacttgacttggattagttgtgtgacagctcatcacaggccgggcagtgtagaccaacacacgctggcctcacggcttctgcggggcaggaaccgtgacccgccctggtgtggcgtgcttctagctgtcacaggtgcccatgtctgtgtgtcccccacaaccccccaacagtaccgcttggggcctggctcactctatcaaccactcacccgtggttatttaccaagaaaatgcaaagcaaaaaaagcaggggttgcaatcctagtctctgataaaacagactttaaaccaatgaagattaaaaaagacaaaaaagggcattacctaatggtaaagggatcaatgcaacaagaagagctaactatcctaaatatacacacacctaatacaggagcacccagattcataaaacaagttcttagagacctacagagagacttaggcaaccacacaataataatgggagactttaacaccccactgtcaatatttgagacagaaaattaacaaggatattcaggacttgaacgcagctctggaccaagcggacctaatagacatctacagaactctccaccctaaatcaacagaatatacattcttctcagcaccacacagcacttactctaaaattaaccacataattggaagtgaaacactcctcagcaaatgcaaaagaacagaaatcctaacagtctttcagaacacagtgcaatcgaattagaactcaggattaagaaacccaaaatcgcagaactacatggaaactgaacaacctgctcctgaatgactactgggtaaataacaaaattaaggcagaaataacgaagttctttgaaaccaatgagaacagagagacaacgtaccagaatccctgggacacagctaaagcagtgttaagagggaaatttatagtgctaaatgcccacatcagaaagcaggaaagatctaaaatcgacaccctgacatcacaattaaaagaactagagaagcaagagcaaacaaattcaaaagctagcaaaagacaagcaagatc
